US011827938B2

(12) United States Patent
Hoffmann et al.

(10) Patent No.: US 11,827,938 B2
(45) Date of Patent: Nov. 28, 2023

(54) METHODS OF PROSTATE CANCER PROGNOSIS

(71) Applicant: KONINKLIJKE PHILIPS N.V., Eindhoven (NL)

(72) Inventors: Ralf Hoffmann, Eindhoven (NL); Eveline Den Biezen-Timmermans, Eindhoven (NL); Dianne Arnoldina Margaretha Wilhelmina Van Strijp, Eindhoven (NL); Anne Godefrida Catharina Van Brussel, Eindhoven (NL); Marcia Alves De Inda, Eindhoven (NL); Janneke Wrobel, Eindhoven (NL); Joannes Baptist Adrianus Dionisius Van Zon, Waalre (NL)

(73) Assignee: KONINKLIJKE PHILIPS N.V., Eindhoven (NL)

( * ) Notice: Subject to any disclaimer, the term of this patent is extended or adjusted under 35 U.S.C. 154(b) by 232 days.

(21) Appl. No.: 15/577,969

(22) PCT Filed: May 26, 2016

(86) PCT No.: PCT/EP2016/061886
§ 371 (c)(1),
(2) Date: Nov. 29, 2017

(87) PCT Pub. No.: WO2016/193110
PCT Pub. Date: Dec. 8, 2016

(65) Prior Publication Data
US 2018/0148795 A1 May 31, 2018

(30) Foreign Application Priority Data
May 29, 2015 (EP) .................................... 15169788

(51) Int. Cl.
C12Q 1/6886 (2018.01)

(52) U.S. Cl.
CPC .... *C12Q 1/6886* (2013.01); *C12Y 301/04001* (2013.01); *C12Q 2600/106* (2013.01); *C12Q 2600/112* (2013.01); *C12Q 2600/118* (2013.01); *C12Q 2600/158* (2013.01)

(58) Field of Classification Search
None
See application file for complete search history.

(56) References Cited

U.S. PATENT DOCUMENTS

| 6,794,141 | B2 | 9/2004 | Erlander |
| 2003/0220273 | A1 | 11/2003 | Bennett |
| 2005/0164220 | A1 | 7/2005 | Gretarsdottir |
| 2005/0287551 | A1* | 12/2005 | Gretarsdottir ............ C12N 9/16 435/6.16 |
| 2007/0218472 | A1 | 9/2007 | Brophy |
| 2012/0065100 | A1 | 3/2012 | Hoffmann |
| 2012/0065148 | A1 | 3/2012 | Hoffmann |
| 2012/0129788 | A1 | 5/2012 | Hoffmann |
| 2014/0364606 | A1 | 12/2014 | Xu |

FOREIGN PATENT DOCUMENTS

| EP | 1471153 A2 | 10/2004 |
| WO | 2002052031 A2 | 7/2002 |
| WO | 2004090157 A1 | 10/2004 |
| WO | 2010059838 A2 | 5/2010 |
| WO | 2010131194 A1 | 11/2010 |
| WO | 2010131195 A1 | 11/2010 |

OTHER PUBLICATIONS

Lavellet et al. Biology of Reproduction 2007. 76: 794-803.*
Powers et al. Molecular Cancer Research. Aug. 22, 2014. 13(1): 149-160 (Year: 2014).*
Henderson et al "The CAMP Phosphodiesterase-4D7 (PDE4D7) is downregulated in androgen-independent prostate cancer cells and mediates proliferation by compartmentalizing cAMP at the plasma membrane of VCaP Prostate Cancer Cells", Bristish Journal of Cancer, vol. 110, No. 5, pp. 1278-1287, 2014.
Merkle et al "Roles of cAMP and cAMP-Dependent Protein Kinase in the Progression of Prostate Cancer: Cross-Talk with the Androgen Receptor", Cellular Signalling, vol. 23, No. 3, pp. 507-515, 2011.
"Affymetrix GeneChip Human Genome U133 Array Set HG-U133a", GEO, Mar. 2002.
Boormans, J.L. et al "Identification of TDRD1 as a direct target gene of ERG in primary prostate cancer", Int J Cancer Jul. 15, 2013; vol. 133, No. 2, pp. 335-345 (GEO data set ID: GSE41408).
Tomlins, S.A. et al "Recurrent Fusion of TMPRSS2 and ETS Transcription factor genes in Prostate Cancer", Science, vol. 310, pp. 644-648, 2005.
Altschul et al "Basic Local Alignment Search Tool" Journal Molecular Biology, vol. 215, pp. 403-410 1990.
Hellemans, G. et al "qBase Relative Quanitification Framework and Software for Management and Automated Analysis of Real-Time Quantitative PCR Data", Genome Biology, vol. 8, No. 2, pp. R19, Feb. 2007.
Anderson, C.L. et al "Normalization of Real-Time Quantitative Reverse Transcription-PCR Data: A Model Based Variance Estimation Approach to Identify Genes Suited for Normalization, Applied to Bladder and Colon Cancer Data Sets", Cancer Research vol. 64, No. 15, pp. 5245-5250, 2004.

(Continued)

*Primary Examiner* — Carla J Myers

(57) ABSTRACT

The present invention relates to methods for diagnosing, monitoring or prognosticating prostate cancer or the progression state of prostate cancer wherein said method determines the state of the prostate cancer, based on the expression level of phosphodiesterase 4D (PDE4D) variants. The invention further relates to a method of identifying an individual for eligibility for prostate cancer therapy. The invention also relates to products for the analysis of phosphodiesterase 4D (PDE4D) variants as well as pharmaceutical compositions modulating the activity and/or expression of PDE4D variants.

12 Claims, 23 Drawing Sheets
Specification includes a Sequence Listing.

(56) References Cited

OTHER PUBLICATIONS

Krutzfeldt, et al, "Silencing of MicroRNAs in vivo with antagomirs", Nature, vol. 438, pp. 685-689. 2005.

Vandesompele, J. et al "Accurate Normalization of Real-Time Quantitative RT-PCR Data by Geometric Averaging of Multiple Internal Control Genes", Genome Biology, vol. 3, No. 7, pp. RESEARCH0034, Jun. 2002.

Taylor, B.S. et al Integrative Genomic Profiling of Human Prostate Cancer. Cancer Cell 18, 11-22, 2010 (GEO data set ID: GSE21032).

Rahrmann, E.P. et al "Identification of PDE4D as a Proliferation Promoting Factor in Prostate Cancer using a Sleeping Beauty Transposon-based Somatic Mutagenesis Screen", Cancer Research, vol. 69, No. 10, 2009, pp. 4388-4397.

Rho, N et al. "Discovery and Validation of a Prostate Cancer Genomic Classifier that Predicts Early Metastasis Following Radical Prostatectomy", PLoS One 8(6), e66855 (2013) (GEO data set ID: GSE46691).

Brase, J.C. et al "TMPRSS2-ERG-specific transcriptional MOdulation is Associated with Prostate Cancer Biomarkers and TGF-b Signaling", BMC Cancer, vol. 11, pp. 507-515, 2011.

Ferlay, Jacques et al "Cancer incidence and mortality worldwide: Sources, methods and major patterns in GLOBOCAN 2012" International Journal of Cancer, vol. 136, E359-E386 2015.

Bangma, C.H., et al Overdiagnosis and overtreatment of early detected prostate cancer. World J Urol 25, 3-9 (2007).

Schroder, F.H. et al. Screening and prostate cancer mortality in a randomized European study. N Engl J Med 360, 1320-1328 (2009).

Mosquera, J.M. et al. Prevalence of TMPRSS2-ERG fusion prostate cancer among men undergoing prostate biopsy in the United States. Clin Cancer Res 15, 4706-4711 (2009).

Nam, R.K. et al. Increasing hospital admission rates for urological complications after transrectal ultrasound guided prostate biopsy. J Urol 183, 963-968 (2010).

Nichol, M.B. et al. Cost-effectiveness of Prostate Health Index for prostate cancer detection. BJU Int (2011).

Snyder, C.F. et al. How does initial treatment choice affect short-term and long-term costs for clinically localized prostate cancer? Cancer 116, 5391-5399 (2010).

Cooperberg, M.R., et al Contemporary trends in low risk prostate cancer: risk assessment and treatment. J Urol 178, S14-19 (2007).

James, M.L. Prostate cancer (early), search date Feb. 2006. Online version of BMJ Clinical Evidence: http://www.clinicalevidence.com.

Medtech Insight U.S. markets for diagnostic and therapeutic prostate disease/disorder management products (2007).

Bangma, C.H. et al, "Defining and predicting indolent and low risk prostate cancer". Critical Reviews in Oncology/Hematology (2011).

Heidenreich, A., etal Extended pelvic lymphadenectomy in patients undergoing radical prostatectomy: high incidence of lymph node metastasis. J Urol 167, 1681-1686 (2002).

Quon, H., et al "Dramatic increase in prostate cancer cases by 2021". BJU Int 108, 1734-1738 (2011).

Bader, P. et al Is a limited lymph node dissection an adequate staging procedure for prostate cancer? J Urol 168, 514-518; discussion 518 (2002).

Knezevic, dEJAN et al "Analytical Validation fo the Oncotype DX Prostate Cacer Assay—A Clinical RT-PCR Assay Optimized for Prostate Needle Biopsies", BMC Genomics, vol. 14, p. 690, 2013.

Cuzick Jack et al "Prognostic Value of an RNA Expression Signature Derived from Cell Cycel Proliferation Genes for Recurrence and death from Prostate Cancer: A Retrospective Study in Two Cohorts", Lancet Oncology, vol. 12, No. 3, pp. 245-255, 2011.

Troung, M.S. "Development and Multi-Institutional Validation of an upgrading risk Tool for Gleason 6 Prostate Cancer", Cancer, vol. 119, pp. 3992-4002, 2013.

Bottcher, R. et al "Human phosphodiesterase 4D7 (PDE4D7) expression is increased in TMPRSS2-ERGpositive primary prostate cancer and independently adds to a reduced risk of post-surgical disease progression". British Journal of Cancer, vol. 113, pp. 1502-1511, 2015.

Bottcher, R. et al "Human PDE4D isoform composition is deregulated in primary prostate cancer and indicative for disease progression and development of distant metastases", ONCOTARGET, vol. 7, No. 43, 2016.

Sperling, Dan, "Revisions of the Gleason grading system make it more accurate," Sperling Prostate Center, 2016.

Klein, E.A. et al, "A 17-gene Assay to Predict Prostate Cancer Aggressiveness in the Context of Gleason Grade Heterogeneity, Tumor Multifocality, and Biopsy Undersampling", European Urology, vol. 66, pp. 550-560, 2014.

Karnes, R. Jeffrey et al "Validation of a Genomic Classifier that Predicts Metastasis Following Radical Prostatectomy in an at Risk Patient Population", Journal of Urology, vol. 160, No. 6, pp. 2047-2053, 2013.

Jin, Byung-Soo et al Pathological upgrading in prostate cancer patients eligible for active surveillance: Does prostate-specific antigen density matter? Korean Journal of Urology, 2015, vol. 56, pp. 624-629.

Byrne, Ashleigh M. et al "The activity of cAMP-phosphodiesterase 4D7 (PDE4D7) is regulated by protein kinase A-dependent phosphorylation within its unique N-terminus", FEBS Letters, vol. 589, pp. 750-755, 2015.

Den, Robert B. et al "Genomic Classifier Identifies Men With Adverse Pathology After Radical Prostatectomy Who Benefit From Adjuvant Radiation Therapy", Journal of Clinical Oncology, vol. 33, No. 8, 2015.

\* cited by examiner

| PDE4D Transcript | Probe Set ID | NCBI RefSeq | Protein Accession | qPCR Primers & Probes; qPCR Amplicon Size [Base Pairs] | | | |
|---|---|---|---|---|---|---|---|
| | | | | Forward | Reverse | Probe | Amplicon Size |
| PDE4D1 | 2858166 | NM_001197222.1 | NP_001184151.1 | AATATGAAGGAGCAGCCCTCA | GTCTCGCTGGCCAGTTTC | CATCCGAGCATGGCGGGA | 84 bp |
| PDE4D2 | 2858166 | NM_001197221.1 | NP_001184150.1 | | | | |
| PDE4D3 | 2858290 | NM_006203.4 | NP_006194.2 | | | | |
| | 2858291 | | | | | | |
| | 2858368 | | | | | | |
| PDE4D4 | 2858369 | NM_001104631.1 | NP_001098101.1 | | | | |
| | 2858370 | | | | | | |
| | 2858345 | | | | | | |
| PDE4D5 | 2858346 | NM_001197218.1 | NP_001184147.1 | GCTTCTCAGCAGCAACATC | TGCCATTGTCCACATCAAAA | ACAGGGGCGTTTCACGGTGGCACA | 74 bp |
| | 2858347 | | | | | | |
| PDE4D6 | 2858155 | NM_001197223.1 | NP_001184152.1 | | | | |
| | 2858156 | | | | | | |
| | 2858406 | | | | | | |
| PDE4D7 | 2858407 | NM_001165899.1 | NP_001159371.1 | GAACATTCAACGACCAACCA | TGCCATTGTCCACATCAAAA | CTGCCGCTGATTGCTATCACTTCTGCA | 95 bp |
| | 2858408 | | | | | | |
| PDE4D8 | 2858257 | NM_001197219.1 | NP_001184148.1 | ATGAGCATTATTATGAAGCCAAGATC | | | |
| | 2858258 | | | | | | |
| PDE4D9 | 2858240 | NM_001197220.1 | NP_001184149.1 | | GTGCCATTGTCCACATCAAAAC | CTACAAGTTCCCTAAGGACTGCAGAGG | 86 bp |
| | 2858241 | | | | | | |

FIG. 1

| Gene Symbol | Gene Name | NCBI RefSeq mRNA | SEQ ID NO mRNA | Protein Accession | SEQ ID NO Protein | qPCR Primers & Probes; qPCR Amplicon Size [Base Pairs] | | | | | | |
|---|---|---|---|---|---|---|---|---|---|---|---|---|
| | | | | | | Forward | SEQ ID NO forward primer | Reverse | SEQ ID NO reverse primer | Probe | SEQ ID NO probe | Amplicon Size |
| TBP | Homo sapiens TATA box binding protein, | NM_003194.4 | 32 | NP_003185.1 | 44 | GCCAAGA AGAAAGT GAACATC AT | 56 | ATAGGGA TTCCGGG AGTCAT | 57 | TCAGAAAC AACAGCC TGCCACC TTA | 58 | 101 |
| HPRT1 | Homo sapiens hypoxant hine phospho ribosyltra nsferase 1 | NM_000194.2 | 33 | NP_000185.1 | 45 | GAGGATT TGGAAAG GGTGTTT ATT | 59 | ACAGAGG GCTACAA TGTGATG | 60 | ACGTCTT GCTCGAG ATGTGAT GAAGG | 61 | 111 |
| ACTB | Homo sapiens actin, beta | NM_001101.3 | 34 | NP_001092.1 | 46 | CCAACC GCGAGA AGATGA | 62 | CCAGAG GCGTAC AGGGAT AG | 63 | CCATGTA CGTTGCT ATCCAG GCT | 64 | 97 |

FIG. 2

| Gene Symbol | Gene Name | NCBI RefSeq mRNA | SEQ ID NO mRNA | Protein Accession | SEQ ID NO Protein | Forward | SEQ ID NO forward primer | Reverse | SEQ ID NO reverse primer | Probe | SEQ ID NO probe | Amplicon Size |
|---|---|---|---|---|---|---|---|---|---|---|---|---|
| RPLP0 | Homo sapiens 60S acidic ribosomal phosphoprotein P0 mRNA | NM_001002.3; NM_053275.3 | 35 36 | NP_000993.1; NP_444505.1 | 47 48 | TAAACCC TGCGTG GCAAT | 65 | ACATTTC GGATAA TCATCCA ATAGTT G | 66 | AAGTAG TTGGACT TCCAGG TCGCC | 67 | 117 |
| POLR2A | Polymerase (RNA) II (DNA Directed) Polypeptide A, 220kDa | NM_000937.4 | 37 | NP_000928.1 | 49 | AGTCCT GAGTCC GGATGA A | 68 | CCTCCCT CAGTCG TCTCT | 69 | TGACGG AGGGTG GCATCA AATACC | 70 | 78 |
| B2M | Beta-2-Microglobulin | NM_004048.2 | 38 | NP_004039.1 | 50 | CCGTGG CCTTAGC TGTG | 71 | CTGCTG GATGAC GTGAGT AAA | 72 | TCTCTCT TTCTGGC CTGGAG GCTA | 73 | 96 |

FIG. 2 (continued)

| Gene Symbol | Gene Name | NCBI RefSeq mRNA | SEQ ID NO mRNA | Protein Accession | SEQ ID NO Protein | Forward | SEQ ID NO forward primer | Reverse | SEQ ID NO reverse primer | Probe | SEQ ID NO probe | Amplicon Size |
|---|---|---|---|---|---|---|---|---|---|---|---|---|
| PUM1 | Homo sapiens pumilio RNA-Binding Family Member 1 | NM_001020658.1; NM_014676.2 | 39 40 | NP_001018494.1; NP_055491.1 | 51 52 | GCCAGCTTGTCTTCAATGAAAT | 74 | CAAAGCCAGCTTCTGTTCAAG | 75 | ATCCACCATGAGTTGGTAGGCAGC | 76 | 119 |
| K-ALPHA-1 (TUBA1B) | Tubulin, Alpha 1b | NM_006082.2 | 41 | NP_006073.2 | 53 | TGACTCCTTCAACACCCTTCTTC | 77 | TGCCAGTGCGAACTTCAT | 78 | CCGGGCTGTGTTTGTAGACTTGGA | 79 | 107 |
| ALAS-1 | Aminolevulinate, Delta-, Synthase | NM_000688.5; NM_199166.2 | 42 43 | NP_000679.1; NP_954635.1 | 54 55 | AGCCACATCATCCTGT | 80 | CGTAGATGTTATGTCTGCTCAT | 81 | TTTAGCAGCATCTGCAACCCGC | 82 | 85 |

FIG. 2 (continued)

| Data Set | Sample 1 | | Sample 2 | | Difference of Means (p=value) | | | | | | |
|---|---|---|---|---|---|---|---|---|---|---|---|
| | Tissue | No of Samples | Tissue | No of Samples | PDE4D1&2 | PDE4D3 | PDE4D4 | PDE4D5 | PDE4D6 | PDE4D7 |
| Patient Set #1[1] | NAT | 29 | Primary PCa, NP | 103 | 1,46E-04 | 5,07E-01 | 7,72E-01 | 2,69E-11 | 3,65E-01 | 1,75E-02 |
| | Primary PCa, NP | 103 | Primary PCa, BCR&CR | 26 | 8,96E-01 | 1,52E-02 | 6,63E-01 | 4,07E-01 | 8,96E-02 | 5,36E-02 |
| | Primary PCa, NP&BCR | 121 | Primary PCa, CR | 8 | 3,49E-01 | 1,59E-02 | 6,99E-01 | 5,80E-02 | 6,47E-02 | 3,71E-02 |
| | Primary PCa, NP | 129 | Metastases | 8 | 1,95E-01 | 8,61E-01 | 7,17E-01 | 8,81E-01 | 3,38E-03 | 4,66E-01 |
| | Primary PCa, NP | 129 | CRPC | 11 | 7,92E-03 | 1,70E-02 | 6,55E-02 | 6,21E-04 | 5,67E-05 | 1,52E-02 |
| Patient Set #2[2] | NAT | 12 | Primary PCa, NP | 22 | 5,19E-01 | 6,78E-03 | 1,96E-03 | 2,43E-02 | 2,16E-01 | 6,41E-03 |
| | Primary PCa, NP | 22 | Primary PCa, BCR&CR | 34 | 2,33E-01 | 3,74E-01 | 7,01E-01 | 3,60E-01 | 3,95E-01 | 1,83E-01 |
| | Primary PCa, NP&BCR | 45 | Primary PCa, CR | 11 | 4,04E-01 | 4,75E-02 | 9,95E-01 | 2,19E-03 | 8,12E-02 | 1,70E-02 |
| | Primary PCa, NP | 56 | Metastases | 12 | 3,98E-02 | 2,32E-01 | 4,81E-01 | 3,24E-01 | 8,80E-02 | 7,82E-02 |

[1] Taylor BS et al. Integrative Genomic Profiling of Human Prostate Cancer. Cancer Cell 18, 11–22, 2010
[2] Boormans JL et al. Identification of TDRD1 as a direct target gene of ERG in primary prostate cancer. Int J Cancer 2013 Jul 15;

FIG. 3

| Data Set | Sample 1 | | Sample 2 | | Difference of Means (p=value) | | | | | | |
|---|---|---|---|---|---|---|---|---|---|---|---|
| | Tissue | No of Samples | Tissue | No of Samples | PDE4D8 | PDE4D9 | PDE4D7-4D5 (PDE-Index_1) | (PDE4D7&4D5)_av (PDE-Index_2) | PDE4D5&7&9/PDE4D4 (PDE-Index_3) | PDE4D5&7&9/PDE4D1&2 (PDE-Index_4) | (PDE4D5&4D7&4D9)_av (PDE-Index_5) |
| Patient Set #1[1] | NAT | 29 | Primary PCa, NP | 103 | 6,88E-03 | 3,39E-02 | 1,93E-14 | 6,61E-02 | 1,39E-01 | 5,18E-01 | 3,53E-02 |
| | Primary PCa, NP | 103 | Primary PCa, BCR&CR | 26 | 6,26E-02 | 8,53E-02 | 1,71E-01 | 9,32E-02 | 4,20E-02 | 2,18E-02 | 6,55E-02 |
| | Primary PCa, NP&BCR | 121 | Primary PCa, CR | 8 | 1,43E-02 | 5,44E-03 | 5,22E-01 | 1,99E-02 | 2,72E-02 | 1,85E-03 | 7,37E-03 |
| | Primary PCa, NP | 129 | Metastases | 8 | 2,20E-01 | 1,55E-02 | 3,05E-01 | 6,59E-01 | 1,55E-01 | 8,98E-01 | 7,32E-01 |
| | Primary PCa, NP | 129 | CRPC | 11 | 5,78E-03 | 9,89E-07 | 8,86E-01 | 1,29E-03 | 2,59E-03 | 2,49E-04 | 5,12E-05 |
| Patient Set #2[2] | NAT | 12 | Primary PCa, NP | 22 | 9,40E-03 | 2,86E-01 | 5,76E-05 | 1,16E-01 | 2,47E-02 | 1,28E-01 | 2,52E-01 |
| | Primary PCa, NP | 22 | Primary PCa, BCR&CR | 34 | 2,21E-01 | 3,18E-01 | 2,18E-01 | 1,82E-01 | 1,56E-01 | 2,33E-01 | 1,61E-01 |
| | Primary PCa, NP&BCR | 45 | Primary PCa, CR | 11 | 8,47E-02 | 2,19E-03 | 8,89E-02 | 5,75E-03 | 7,95E-04 | 7,65E-04 | 1,69E-03 |
| | Primary PCa, NP | 56 | Metastases | 12 | 9,42E-02 | 5,47E-05 | 1,19E-01 | 9,60E-02 | 1,75E-02 | 2,15E-02 | 2,03E-02 |

FIG. 3 (continued)

| Data Set | | Sample 1 | | Sample 2 | | Difference of Means (p=value) | | | | | |
|---|---|---|---|---|---|---|---|---|---|---|---|
| | | Tissue | No of Samples | Tissue | No of Samples | PDE4D1&2 | PDE4D3 | PDE4D4 | PDE4D5 | PDE4D6 | PDE4D7 |
| Pat. Set #1 [1] | | NAT | 15 | Prim. PCa | 49 | N/A | N/A | N/A | 7,02E-08 | N/A | 6,86E-02 |
| | | NAT&BL&H | 47 | Prim. PCa | 49 | N/A | N/A | N/A | 1,73E-06 | N/A | 1,31E-04 |
| | | BL&H | 32 | Prim. PCa | 49 | N/A | N/A | N/A | 3,87E-05 | N/A | 4,00E-04 |
| | | H | 11 | Prim. PCa | 49 | N/A | N/A | N/A | 4,31E-02 | N/A | 3,20E-02 |
| Pat. Set #2 [2] | | NAT | 32 | Prim. PCa | 107 | N/A | N/A | N/A | 2,16E-06 | N/A | 6,16E-02 |
| | | NAT&BL | 36 | Prim. PCa | 107 | N/A | N/A | N/A | 4,31E-07 | N/A | 4,81E-02 |
| | | BL | 4 | Prim. PCa | 107 | N/A | N/A | N/A | N/A | N/A | N/A |
| Pat. Set #3 [3] | | NAT | 29 | Prim. PCa | 121 | 1,46E-04 | 5,07E-01 | 7,72E-01 | 2,69E-11 | 3,65E-01 | 1,75E-02 |
| Pat. Set #4 [4] | | NAT | 12 | Prim. PCa | 40 | 5,19E-01 | 6,78E-03 | 1,96E-03 | 2,43E-02 | 2,16E-01 | 6,41E-03 |
| Pat. Set #5 [5] | | NAT | 48 | Prim. PCa | 47 | 3,55E-04 | 2,18E-01 | 3,72E-04 | 1,21E-08 | 3,59E-04 | 4,27E-04 |
| Pat. Set #6 [6] | | NAT | 36 | Prim. PCa | 157 | 5,39E-05 | 4,81E-02 | 4,40E-02 | 1,78E-16 | 9,18E-01 | 2,52E-03 |

[1] Origene Inc, USA
[2] Jenster G. et al; EMC Rotterdam, The Netherlands
[3] Taylor BS et al. Integrative Genomic Profiling of Human Prostate Cancer. Cancer Cell 18, 11–22, 2010
[4] Boormans JL et al. Identification of TDRD1 as a direct target gene of ERG in primary prostate cancer. Int J Cancer 2013 Jul 15;133(2):335-45.
[5] Brase JC et al; TMPRSS2-ERG -specific transcriptional modulation is associated with prostate cancer biomarkers and TGF-b signaling. BMC Cancer 2011, 11, 507-515
[6] TCGA RNA seq Data Set Prostate Cancer (Release September 2013)

FIG. 4

| Data Set | Sample 1 | | Sample 2 | | Difference of Means (p=value) | | | | | | |
|---|---|---|---|---|---|---|---|---|---|---|---|
| | Tissue | No of Samples | Tissue | No of Samples | PDE4D8 | PDE4D9 | (PDE4D7-4D5)_av PDE-Index_1 | (PDE4D7&4D5)_av PDE-Index_2 | (PDE4D5&7&9/PDE4D4) PDE-Index_3 | (PDE4D5&7&9/PDE4D1&2) PDE-Index_4 | (PDE4D5&4D7&4D9)_av PDE-Index_5 |
| Pat. Set #1 [1] | NAT | 15 | Prim. PCa | 49 | N/A | N/A | 3,83E-05 | N/A | N/A | N/A | N/A |
| | NAT&BL&H | 47 | Prim. PCa | 49 | N/A | N/A | 1,03E-09 | N/A | N/A | N/A | N/A |
| | BL&H | 32 | Prim. PCa | 49 | N/A | N/A | 6,02E-08 | N/A | N/A | N/A | N/A |
| | H | 11 | Prim. PCa | 49 | N/A | N/A | 1,03E-03 | N/A | N/A | N/A | N/A |
| Pat. Set #2 [2] | NAT | 32 | Prim. PCa | 107 | N/A | N/A | 1,46E-09 | N/A | N/A | N/A | N/A |
| | NAT&BL | 36 | Prim. PCa | 107 | N/A | N/A | 2,26E-10 | N/A | N/A | N/A | N/A |
| | BL | 4 | Prim. PCa | 107 | N/A | N/A | N/A | N/A | N/A | N/A | N/A |
| Pat. Set #3 [3] | NAT | 29 | Prim. PCa | 121 | 6,88E-03 | 3,39E-02 | 1,93E-14 | 6,61E-02 | 1,39E-01 | 5,18E-01 | 3,53E-02 |
| Pat. Set #4 [4] | NAT | 12 | Prim. PCa | 40 | 9,40E-03 | 2,86E-01 | 5,76E-05 | 1,16E-01 | 2,47E-02 | 1,28E-01 | 2,52E-01 |
| Pat. Set #5 [5] | NAT | 48 | Prim. PCa | 47 | 6,58E-01 | 1,06E-03 | 8,09E-13 | 9,17E-02 | 6,17E-01 | 9,72E-01 | 9,55E-03 |
| Pat. Set #6 [6] | NAT | 36 | Prim. PCa | 157 | 3,38E-02 | 3,40E-03 | 2,01E-02 | 8,74E-07 | N/A | N/A | 5,12E-05 |

FIG. 4 (continued)

| Data Set | Sample 1 | | Sample 2 | | Difference of Means | ROC Analysis | | |
|---|---|---|---|---|---|---|---|---|
| PDE4D7-PDE4D5 (PDE-Index_1) | Tissue | No of Samples | Tissue | No of Samples | p-value | AUC | 95% CI AUC | p-value |
| Patient Set #1[1] | N | 15 | T | 49 | 1,17E-04 | 0,84 | 0.72-0.92 | <1.00E-04 |
| | N&BL&H | 47 | T | 49 | 1,03E-09 | 0,85 | 0.76-0.92 | <1.00E-04 |
| | BL&H | 32 | T | 49 | 6,02E-08 | 0,86 | 0.76-0.93 | <1.00E-04 |
| | H | 11 | T | 49 | 1,03E-03 | 0,87 | 0.75-0.95 | <1.00E-04 |
| Patient Set #2[2] | N | 20 | T | 28 | 5,65E-02 | 0,67 | 0.52-0.8 | 3,00E-02 |
| | N&BL | 72 | T | 28 | 5,92E-05 | 0,83 | 0.74-0.9 | <1.00E-04 |
| | BL | 52 | T | 28 | 7,51E-06 | 0,89 | 0.8-0.95 | <1.00E-04 |
| Patient Set #3[3] | N | 27 | T | 27 | 8,54E-05 | 0,85 | 0.73-0.93 | <1.00E-04 |
| | N&BL | 62 | T | 27 | 4,00E-10 | 0,9 | 0.82-0.95 | <1.00E-04 |
| | BL | 35 | T | 27 | 8,07E-11 | 0,94 | 0.84-0.98 | <1.00E-04 |
| Patient Set #4[4] | N | 32 | T | 107 | 1,46E-09 | 0,85 | 0.78-0.91 | <1.00E-04 |
| | N&BL | 36 | T | 107 | 2,26E-10 | 0,85 | 0.78-0.91 | <1.00E-04 |
| | BL | 4 | T | 107 | N/A | N/A | N/A | N/A |
| Patient Set #5[5] | N | 29 | T | 121 | 1,93E-14 | 0,93 | 0.87-0.96 | <1.00E-04 |
| Patient Set #6[6] | N | 12 | T | 40 | 1,48E-06 | 0,94 | 0.80-0.99 | <1.00E-04 |
| Patient Set #7[7] | N | 48 | T | 47 | 1,81E-12 | 0,91 | 0.83-0.96 | <1.00E-04 |
| Patient Set #8[8] | N | 36 | T | 157 | 6,85E-17 | 0,89 | 0.84-0.93 | <1.00E-04 |

[1] Origene Inc, USA    [2] Asterand Inc, USA    [3] Asterand Inc, USA

[4] Jenster G. et al; EMC Rotterdam, The Netherlands

[5] Taylor BS et al. Integrative Genomic Profiling of Human Prostate Cancer. Cancer Cell 18, 11–22, 2010

[6] Boormans JL et al. Identification of TDRD1 as a direct target gene of ERG in primary prostate cancer. Int J Cancer 2013 Jul 15;133(2):335-45.

[7] Brase JC et al; TMPRSS2-ERG -specific transcriptional modulation is associated with prostate cancer biomarkers and TGF-b signaling. BMC Cancer 2011, 11, 507-515

[8] TCGA RNA seq Data Set Prostate Cancer (Release September 2013)

FIG. 5

| Data Set | Sample 1 | | Sample 2 | | ROC Analysis | | | | | | |
|---|---|---|---|---|---|---|---|---|---|---|---|
| | | | | | (PDE4D7&4D5)_av | | | (PDE4D5&7&9/PDE4D4) | | | |
| | | | | | PDE-Index_2 | | | PDE-Index_3 | | | |
| | Tissue | No of Samples | Tissue | No of Samples | AUC | 95% CI | p-value | AUC | 95% CI | p-value |
| Patient Set #1[1] | Primary PCa, NP | 103 | Primary PCa, BCR&CR | 26 | 0,64 | 0.55-0.72 | 4,00E-02 | 0,62 | 0.53-0.7 | 5,00E-02 |
| | Primary PCa, NP&BCR | 121 | Primary PCa, CR | 8 | 0,78 | 0.70-0.85 | 5,00E-04 | 0,75 | 0.66-0.82 | 7,00E-03 |
| | Primary PCa (all) | 129 | Metastases | 8 | 0,61 | 0.52-0.7 | 4,40E-01 | 0,69 | 0.59-0.77 | 9,00E-02 |
| | Primary PCa (all) | 129 | CRPC | 11 | 0,84 | 0.76-0.9 | 1,00E-04 | 0,83 | 0.75-0.89 | <1.00E-04 |
| Patient Set #2[2] | Primary PCa, NP | 22 | Primary PCa, BCR&CR | 34 | 0,64 | 0.5-0.77 | 5,00E-02 | 0,66 | 0.52-0.78 | 3,40E-02 |
| | Primary PCa, NP&BCR | 45 | Primary PCa, CR | 11 | 0,85 | 0.73-0.93 | <1.00E-04 | 0,87 | 0.76-0.95 | <1.00E-04 |
| | Primary PCa, NP | 56 | Metastases | 12 | 0,71 | 0.53-0.86 | 3,00E-02 | 0,74 | 0.56-0.88 | 1,00E-02 |

FIG. 6

[1] Taylor BS et al. Integrative Genomic Profiling of Human Prostate Cancer. Cancer Cell 18, 11–22, 2010
[2] Boormans JL et al. Identification of TDRD1 as a direct target gene of ERG in primary prostate cancer. Int J Cancer 2013 Jul 15;133(2):335-45.

| Data Set | Sample 1 | | Sample 2 | | ROC Analysis | | | | | | |
|---|---|---|---|---|---|---|---|---|---|---|---|
| | | | | | (PDE4D5&7&9/PDE4D1&2) | | | (PDE4D5&4D7&4D9)_av | | | |
| | | | | | PDE-Index_4 | | | PDE-Index_5 | | | |
| | Tissue | No of Samples | Tissue | No of Samples | AUC | 95% CI | p-value | AUC | 95% CI | p-value |
| Patient Set #1[1] | Primary PCa, NP | 103 | Primary PCa, BCR&CR | 26 | 0,64 | 0.55-0.72 | 2,30E-02 | 0,64 | 0.55-0.73 | 3,00E-02 |
| | Primary PCa, NP&BCR | 121 | Primary PCa, CR | 8 | 0,81 | 0.73-0.88 | <1.00E-04 | 0,83 | 0.75-0.89 | <1.00E-04 |
| | Primary PCa (all) | 129 | Metastases | 8 | 0,60 | 0.5-0.7 | 4,20E-01 | 0,66 | 0.56-0.75 | 2,00E-01 |
| | Primary PCa (all) | 129 | CRPC | 11 | 0,82 | 0.74-0.89 | 8,00E-04 | 0,9 | 0.83-0.95 | <1.00E-04 |
| Patient Set #2[2] | Primary PCa, NP | 22 | Primary PCa, BCR&CR | 34 | 0,63 | 0.49-0.75 | 1,00E-01 | 0,66 | 5,20E-01 | 3,50E-02 |
| | Primary PCa, NP&BCR | 45 | Primary PCa, CR | 11 | 0,89 | 0.78-0.96 | <1.00E-04 | 0,87 | 0.75-0.92 | <1.00E-04 |
| | Primary Pca, NP | 56 | Metastases | 12 | 0,77 | 0.58-0.9 | 1,00E-03 | 0,78 | 0.61-0.9 | 2,00E-03 |

FIG. 6 (continued)

| Data Set | Sample 1 | | | Sample 2 | | | Difference of Means (p=value) | | | | |
|---|---|---|---|---|---|---|---|---|---|---|---|
| | Tissue | T2-ERG | No of Samples | Tissue | T2-ERG | No of Samples | PDE4D1&2 | PDE4D3 | PDE4D4 | PDE4D5 |
| Patient Set #1[1] | NAT | negative | 29 | Primary PCa | negative | 81 | 4,67E-04 | 2,46E-01 | 8,29E-01 | 1,37E-11 |
| | NAT | negative | 29 | Primary PCa | positive | 48 | 1,03E-03 | 7,95E-02 | 2,98E-01 | 5,27E-06 |
| | Primary PCa | negative | 81 | Primary PCa | positive | 48 | 6,04E-01 | 1,92E-04 | 1,82E-01 | 5,37E-02 |
| Patient Set #2[2] | NAT | negative | 12 | Primary PCa | negative | 32 | 4,58E-02 | 9,20E-02 | 1,47E-04 | 2,44E-02 |
| | NAT | negative | 12 | Primary PCa | positive | 30 | 4,54E-02 | 2,35E-02 | 1,42E-02 | 3,42E-04 |
| | Primary PCa | negative | 32 | Primary PCa | positive | 30 | 6,86E-01 | 1,22E-01 | 2,27E-01 | 4,95E-01 |
| Patient Set #3[3] | NAT | negative | 48 | Primary PCa | negative | 20 | 1,07E-02 | 1,30E-03 | 1,36E-02 | 2,21E-07 |
| | NAT | negative | 48 | Primary PCa | positive | 17 | 2,25E-02 | 6,44E-01 | 1,05E-02 | 9,01E-04 |
| | Primary PCa | negative | 20 | Primary PCa | positive | 20 | 6,92E-01 | 8,85E-03 | 9,53E-01 | 2,99E-02 |
| Patient Set #4[4] | NAT | negative | 36 | Primary PCa | negative | 73 | 2,20E-03 | 6,33E-02 | 2,07E-01 | 8,56E-12 |
| | NAT | negative | 36 | Primary PCa | positive | 75 | 2,36E-04 | 1,75E-01 | 1,07E-02 | 9,05E-10 |
| | Primary PCa | negative | 73 | Primary PCa | positive | 75 | 5,80E-01 | 7,54E-01 | 1,70E-01 | 1,76E-01 |

[1]Taylor BS et al. Integrative Genomic Profiling of Human Prostate Cancer. Cancer Cell 18, 11–22, 2010
[2]Boormans JL et al. Identification of TDRD1 as a direct target gene of ERG in primary prostate cancer. Int J Cancer 2013 Jul 15;133(2):335-45.
[3]Brase JC et al; TMPRSS2-ERG -specific transcriptional modulation is associated with prostate cancer biomarkers and TGF-b signaling. BMC Cancer 2011, 11, 507-515
[4]TCGA RNA seq Data Set Prostate Cancer (Release September 2013)

FIG. 7

| Data Set | Sample 1 | | | Sample 2 | | | Difference of Means (p=value) | | | |
|---|---|---|---|---|---|---|---|---|---|---|
| | Tissue | T2-ERG | No of Samples | Tissue | T2-ERG | No of Samples | PDE4D6 | PDE4D7 | PDE4D8 | PDE4D9 |
| Patient Set #1 | NAT | negative | 29 | Primary PCa | negative | 81 | 2,38E-02 | 9,16E-01 | 2,30E-07 | 9,32E-03 |
| | NAT | negative | 29 | Primary PCa | positive | 48 | 9,92E-01 | 2,63E-05 | 4,83E-01 | 3,27E-02 |
| | Primary PCa | negative | 81 | Primary PCa | positive | 48 | 1,43E-02 | 5,14E-10 | 2,69E-05 | 8,03E-01 |
| Patient Set #2 | NAT | negative | 12 | Primary PCa | negative | 32 | 8,62E-01 | 2,24E-01 | 3,10E-01 | 8,99E-02 |
| | NAT | negative | 12 | Primary PCa | positive | 30 | 6,55E-01 | 3,60E-02 | 1,19E-01 | 2,14E-03 |
| | Primary PCa | negative | 32 | Primary PCa | positive | 30 | 7,41E-01 | 2,97E-02 | 3,35E-01 | 3,15E-01 |
| Patient Set #3 | NAT | negative | 48 | Primary PCa | negative | 20 | 3,84E-03 | 8,21E-01 | 1,40E-01 | 7,83E-05 |
| | NAT | negative | 48 | Primary PCa | positive | 17 | 9,83E-02 | 1,57E-10 | 1,87E-02 | 4,74E-02 |
| | Primary PCa | negative | 20 | Primary PCa | positive | 20 | 2,12E-01 | 9,38E-07 | 9,22E-03 | 7,31E-02 |
| Patient Set #4 | NAT | negative | 36 | Primary PCa | negative | 73 | 5,96E-01 | 1,83E-02 | 4,06E-02 | 6,55E-03 |
| | NAT | negative | 36 | Primary PCa | positive | 75 | 8,40E-01 | 6,60E-05 | 3,05E-02 | 7,54E-03 |
| | Primary PCa | negative | 73 | Primary PCa | positive | 75 | 3,44E-01 | 2,90E-06 | 9,12E-01 | 9,46E-01 |

FIG. 7 (continued)

| Data Set | Sample 1 | | | Sample 2 | | | Difference of Means (p=value) | | | | |
|---|---|---|---|---|---|---|---|---|---|---|---|
| | Tissue | T2-ERG | No of Samples | Tissue | T2-ERG | No of Samples | (PDE4D7-4D5) | (PDE4D7&4D5)_av | (PDE4D5&7&9/PDE4D4) | (PDE4D5&7&9/PDE4D1&2) | (PDE4D5&7&9)_av |
| | | | | | | | PDE-Index_1 | PDE-Index_2 | PDE-Index_3 | PDE-Index_4 | PDE-Index_5 |
| Patient Set #1 | NAT | negative | 29 | Primary PCa | negative | 81 | 5,32E-11 | 6,40E-07 | 2,45E-03 | 2,82E-01 | 4,25E-06 |
| | NAT | negative | 29 | Primary PCa | positive | 48 | 2,28E-15 | 6,80E-01 | 8,88E-01 | 5,75E-02 | 7,22E-01 |
| | Primary PCa | negative | 81 | Primary PCa | positive | 48 | 1,55E-06 | 6,84E-07 | 1,01E-03 | 5,11E-04 | 2,04E-04 |
| Patient Set #2 | NAT | negative | 12 | Primary PCa | negative | 32 | 5,28E-04 | 7,09E-01 | 5,10E-01 | 9,18E-01 | 5,67E-01 |
| | NAT | negative | 12 | Primary PCa | positive | 30 | 2,41E-04 | 4,36E-01 | 3,47E-01 | 5,22E-01 | 2,72E-01 |
| | Primary PCa | negative | 32 | Primary PCa | positive | 30 | 3,78E-03 | 1,35E-01 | 8,55E-01 | 3,34E-01 | 5,50E-02 |
| Patient Set #3 | NAT | negative | 48 | Primary PCa | negative | 20 | 2,61E-07 | 2,23E-05 | 1,97E-02 | 4,98E-03 | 1,16E-05 |
| | NAT | negative | 48 | Primary PCa | positive | 17 | 1,78E-12 | 8,60E-02 | 4,47E-02 | 4,89E-02 | 7,38E-01 |
| | Primary PCa | negative | 20 | Primary PCa | positive | 20 | 6,22E-04 | 1,84E-06 | 1,88E-03 | 8,77E-05 | 7,51E-05 |
| Patient Set #4 | NAT | negative | 36 | Primary PCa | negative | 73 | 1,33E-12 | 3,26E-10 | N/A | 9,25E-01 | N/A |
| | NAT | negative | 36 | Primary PCa | positive | 75 | 3,61E-12 | 1,10E-02 | N/A | 7,75E-02 | N/A |
| | Primary PCa | negative | 73 | Primary PCa | positive | 75 | 1,15E-02 | 2,02E-05 | N/A | 2,46E-02 | N/A |

FIG. 7 (continued)

| Data Set | TMPRSS2-ERG Status | pGleason Pairwise Comparison ||||| Difference of Means (p=value) |||||
|---|---|---|---|---|---|---|---|---|---|---|
| | | pGleason Group | No of Samples | pGleason Group | No of Samples | PDE4D1&2 | PDE4D3 | PDE4D4 | PDE4D5 |
| Patient Set #1[1] | negative | 3+4 | 27 | 4+3 | 13 | 6,99E-01 | 6,20E-01 | 8,56E-01 | 1,38E-01 |
| | | 3+3 & 3+4 | 57 | 4+3 & >=4+4 | 24 | 7,82E-01 | 8,80E-02 | 5,63E-01 | 8,15E-01 |
| | positive | 3+4 | 25 | 4+3 | 8 | 1,50E-01 | 1,38E-02 | 3,86E-01 | 3,03E-02 |
| | | 3+3 & 3+4 | 36 | 4+3 & >=4+4 | 11 | 2,55E-02 | 3,35E-03 | 1,05E-01 | 9,79E-03 |
| Patient Set #2[2] | negative | 3+4 | 8 | 4+3 | 9 | 5,57E-01 | 5,34E-01 | 6,92E-01 | 2,82E-01 |
| | | 3+3 & 3+4 | 8 | 4+3 & >=4+4 | 16 | 6,10E-01 | 1,78E-01 | 7,71E-01 | 2,83E-01 |
| | positive | 3+4 | 6 | 4+3 | 6 | 9,07E-01 | 2,07E-01 | 9,91E-01 | 8,13E-01 |
| | | 3+3 & 3+4 | 9 | 4+3 & >=4+4 | 7 | 6,26E-01 | 3,20E-01 | 7,04E-01 | 8,88E-01 |

[1] Taylor BS et al. Integrative Genomic Profiling of Human Prostate Cancer. Cancer Cell 18, 11–22, 2010
[2] Brase JC et al; TMPRSS2-ERG -specific transcriptional modulation is associated with prostate cancer biomarkers and TGF-b signaling. BMC Cancer 2011, 11, 507–515

FIG. 8

| Data Set | TMPRSS2-ERG Status | pGleason Pairwise Comparison | | | | Difference of Means (p=value) | | | | |
|---|---|---|---|---|---|---|---|---|---|---|
| | | pGleason Group | No of Samples | pGleason Group | No of Samples | PDE4D6 | PDE4D7 | PDE4D8 | PDE4D9 | |
| Patient Set #1 | negative | 3+4 | 27 | 4+3 | 13 | 6,96E-01 | 3,48E-01 | 5,88E-01 | 5,06E-01 | |
| | | 3+3 & 3+4 | 57 | 4+3 & >=4+4 | 24 | 1,55E-01 | 8,42E-01 | 4,33E-01 | 1,11E-01 | |
| | positive | 3+4 | 25 | 4+3 | 8 | 2,54E-01 | 5,72E-02 | 1,92E-02 | 4,94E-02 | |
| | | 3+3 & 3+4 | 36 | 4+3 & >=4+4 | 11 | 7,72E-02 | 7,22E-03 | 1,34E-03 | 1,92E-02 | |
| Patient Set #2 | negative | 3+4 | 8 | 4+3 | 9 | 9,00E-01 | 2,90E-01 | 9,34E-01 | 4,17E-01 | |
| | | 3+3 & 3+4 | 8 | 4+3 & >=4+4 | 16 | 5,35E-01 | 7,85E-01 | 7,54E-01 | 1,87E-01 | |
| | positive | 3+4 | 6 | 4+3 | 6 | 2,95E-01 | 7,56E-02 | 7,03E-01 | 5,21E-01 | |
| | | 3+3 & 3+4 | 9 | 4+3 & >=4+4 | 7 | 1,31E-01 | 7,16E-02 | 5,27E-01 | 3,48E-01 | |

FIG. 8 (continued)

| Data Set | TMPRSS2-ERG Status | pGleason Pairwise Comparison | | | | Difference of Means (p=value) | | | | |
|---|---|---|---|---|---|---|---|---|---|---|
| | | pGleason Group | No of Samples | pGleason Group | No of Samples | (PDE4D7-4D5) PDE-Index_1 | (PDE4D7&4D5)_av PDE-Index_2 | (PDE4D5&7&9 /PDE4D4) PDE-Index_3 | (PDE4D5&7&9/PDE4D1&2) PDE-Index_4 | (PDE4D5&4D7&4D9)_av PDE-Index_5 |
| Patient Set #1 | negative | 3+4 | 27 | 4+3 | 13 | 7,99E-01 | 1,14E-01 | 5,51E-01 | 1,42E-01 | 1,65E-01 |
| | | 3+3 & 3+4 | 57 | 4+3 & >=4+4 | 24 | 9,38E-01 | 7,84E-01 | 3,46E-01 | 6,42E-01 | 6,83E-01 |
| | positive | 3+4 | 25 | 4+3 | 8 | 3,87E-01 | 3,04E-02 | 2,72E-02 | 1,01E-02 | 2,90E-02 |
| | | 3+3 & 3+4 | 36 | 4+3 & >=4+4 | 11 | 2,51E-01 | 3,32E-03 | 2,96E-02 | 1,05E-02 | 3,72E-03 |
| Patient Set #2 | negative | 3+4 | 8 | 4+3 | 9 | 2,05E-01 | 9,37E-01 | 5,37E-01 | 1,96E-01 | 9,72E-01 |
| | | 3+3 & 3+4 | 8 | 4+3 & >=4+4 | 16 | 3,24E-01 | 5,13E-01 | 2,54E-01 | 4,60E-02 | 1,22E-01 |
| | positive | 3+4 | 6 | 4+3 | 6 | 1,60E-01 | 1,69E-01 | 3,61E-01 | 1,79E-01 | 1,80E-01 |
| | | 3+3 & 3+4 | 9 | 4+3 & >=4+4 | 7 | 1,08E-01 | 1,51E-01 | 3,77E-01 | 2,14E-01 | 2,14E-01 |

FIG. 8 (continued)

| Data Set | Endpoint | Sample 1 | | Sample 2 | | TMPRSS2-ERG Status | Logistic Regression Modeling | | | | | | | |
|---|---|---|---|---|---|---|---|---|---|---|---|---|---|---|
| | | | | | | | Model | (PDE4D7&4D5)_av PDE-Index_2 | | | (PDE4D5&7&9/PDE4D4) PDE-Index_3 | | | |
| | | Tissue | No of Samples | Tissue | No of Samples | | | AUC | 95% CI HR | p-value | AUC | 95% CI HR | p-value | |
| Patient Set #1[1] | BCR Free Survival | No Progression | 63 | Progression | 8 | neg. | pGleas. & pT St. | 0,82 | 0.72-0.90 | <1.0E-04 | 0,82 | 0.72-0.90 | <1.0E-04 | |
| | | | | | | | pGleas. & pT St. & PDE4DX m. | 0,82 | 0.72-0.89 | 1,00E-04 | 0,81 | 0.70-0.88 | 1,00E-04 | |
| | | | 77 | | 4 | pos. | pGleas. & pT St. | 0,69 | 0.54-0.81 | 5,00E-02 | 0,69 | 0.54-0.81 | 5,00E-02 | |
| | | | | | | | pGleas. & pT St. & PDE4DX m. | 0,73 | 0.58-0.85 | 1,00E-01 | 0,7 | 0.55-0.82 | 1,20E-01 | |
| Patient Set #1[1] | CR Free Survival | No Progression | 40 | Progression | 8 | neg. | pGleas. & pT St. | 0,95 | 0.87-98 | 2,60E-03 | 0,95 | 0.87-98 | 2,60E-03 | |
| | | | | | | | pGleas. & pT St. & PDE4DX m. | 0,96 | 0.88-0.98 | 9,00E-04 | 0,96 | 0.89-0.99 | 1,40E-03 | |
| | | | 44 | | 4 | pos. | pGleas. & pT St. | 0,92 | 0.80-0.98 | 4,00E-04 | 0,92 | 0.80-0.98 | 4,00E-04 | |
| | | | | | | | pGleas. & pT St. & PDE4DX m. | 0,97 | 0.88-0.99 | 3,00E-04 | 0,95 | 0.84-0.99 | 9,00E-04 | |
| Patient Set #2[2] | BCR Free Survival | No Progression | 9 | Progression | 17 | neg. | pGleas. & pT St. | 0,61 | 0.4-0.8 | 6,70E-01 | 0,61 | 0.4-0.8 | 6,70E-01 | |
| | | | | | | | pGleas. & pT St. & PDE4DX m. | 0,66 | 0.45-0.83 | 6,90E-01 | 0,71 | 0.48-0.85 | 7,10E-01 | |
| | | | 19 | | 7 | pos. | pGleas. & pT St. | 0,83 | 0.65-0.94 | 2,20E-03 | 0,83 | 0.65-0.94 | 2,20E-03 | |
| | | | | | | | pGleas. & pT St. & PDE4DX m. | 0,88 | 0.71-0.97 | 1,30E-03 | 0,89 | 0.72-0.97 | 2,00E-03 | |
| Patient Set #2[2] | CR Free Survival | No Progression | 13 | Progression | 17 | neg. | pGleas. & pT St. | 0,73 | 0.52-0.88 | 1,70E-01 | 0,73 | 0.52-0.88 | 1,70E-01 | |
| | | | | | | | pGleas. & pT St. & PDE4DX m. | 0,9 | 0.71-0.98 | 5,90E-02 | 0,93 | 0.75-0.99 | 2,50E-02 | |
| | | | 26 | | 4 | pos. | pGleas. & pT St. | 0,80 | 0.61-0.92 | 7,00E-02 | 0,80 | 0.61-0.92 | 7,00E-02 | |
| | | | | | | | pGleas. & pT St. & PDE4DX m. | 0,9 | 0.82-0.97 | 1,30E-03 | 0,93 | 0.78-0.99 | 9,00E-03 | |

[1] Taylor BS et al. Integrative Genomic Profiling of Human Prostate Cancer. Cancer Cell 18, 11–22, 2010
[2] Boormans JL et al. Identification of TDRD1 as a direct target gene of ERG in primary prostate cancer. Int J Cancer 2013 Jul 15;133(2):335-45.

FIG. 9

| Data Set | Endpoint | Sample 1 | | Sample 2 | | TMPRSS2-ERG Status | Logistic Regression Modeling | | | | | | |
| --- | --- | --- | --- | --- | --- | --- | --- | --- | --- | --- | --- | --- | --- |
| | | Tissue | No of Samples | Tissue | No of Samples | | Model | (PDE4D5&7&9/PDE4D1&2) PDE-Index_4 | | | (PDE4D5&4D7&4D9)_av PDE-Index_5 | | |
| | | | | | | | | AUC | 95% CI HR | p-value | AUC | 95% CI HR | p-value |
| Patient Set #1[1] | BCR Free Survival | No Progression | 63 | Progression | 8 | neg. | pGleas. & pT St. | 0,82 | 0.72-0.90 | <1.0E-04 | 0,82 | 0.72-0.90 | <1.0E-04 |
| | | | 77 | | 4 | pos. | pGleas. & pT St. & PDE4DX m. | 0,82 | 0.71-0.89 | 1,00E-04 | 0,82 | 0.72-0.90 | <1.0E-04 |
| Patient Set #1[1] | CR Free Survival | No Progression | 40 | Progression | 8 | neg. | pGleas. & pT St. | 0,69 | 0.54-0.81 | 5,00E-02 | 0,69 | 0.54-0.81 | 5,00E-02 |
| | | | 44 | | 4 | pos. | pGleas. & pT St. & PDE4DX m. | 0,73 | 0.59-0.85 | 7,00E-02 | 0,74 | 0.59-0.84 | 1,00E-01 |
| Patient Set #2[2] | BCR Free Survival | No Progression | 9 | Progression | 17 | neg. | pGleas. & pT St. | 0,95 | 0.87-98 | 2,60E-03 | 0,95 | 0.87-98 | 2,60E-03 |
| | | | 19 | | 7 | pos. | pGleas. & pT St. & PDE4DX m. | 0,94 | 0.87-0.98 | 1,30E-03 | 0,97 | 0.9-0.99 | 6,00E-04 |
| Patient Set #2[2] | CR Free Survival | No Progression | 13 | Progression | 17 | neg. | pGleas. & pT St. | 0,92 | 0.80-0.98 | 4,00E-04 | 0,92 | 0.80-0.98 | 4,00E-04 |
| | | | 26 | | 4 | pos. | pGleas. & pT St. & PDE4DX m. | 0,98 | 0.88-0.99 | 1,00E-04 | 0,97 | 0.88-0.99 | 5,00E-04 |
| | | | | | | neg. | pGleas. & pT St. | 0,61 | 0.4-0.8 | 6,70E-01 | 0,61 | 0.4-0.8 | 6,70E-01 |
| | | | | | | | pGleas. & pT St. & PDE4DX m. | 0,63 | 0.42-0.81 | 8,40E-01 | 0,66 | 0.45-0.08 | 8,10E-01 |
| | | | | | | pos. | pGleas. & pT St. | 0,83 | 0.65-0.94 | 2,20E-03 | 0,83 | 0.65-0.94 | 2,20E-03 |
| | | | | | | | pGleas. & pT St. & PDE4DX m. | 0,88 | 0.71-0.97 | 3,00E-03 | 0,9 | 0.74-0.98 | 1,10E-03 |
| | | | | | | neg. | pGleas. & pT St. | 0,73 | 0.52-0.88 | 1,70E-01 | 0,73 | 0.52-0.88 | 1,70E-01 |
| | | | | | | | pGleas. & pT St. & PDE4DX m. | 0,87 | 0.68-0.97 | 5,80E-02 | 0,95 | 0.78-0.99 | 3,80E-02 |
| | | | | | | pos. | pGleas. & pT St. | 0,80 | 0.61-0.92 | 7,00E-02 | 0,80 | 0.61-0.92 | 7,00E-02 |
| | | | | | | | pGleas. & pT St. & PDE4DX m. | N/A | N/A | N/A | 0,97 | 0.83-1.00 | 1,40E-03 |

FIG. 9 (continued)

METHODS OF PROSTATE CANCER PROGNOSIS

CROSS-REFERENCE TO PRIOR APPLICATIONS

This application is the U.S. National Phase application under 35 U.S.C. § 371 of International Application No. PCT/EP2016/061886, filed on May 26, 2016, which claims the benefit of European Patent Application No. 15169788.5, filed on May 29, 2015. These applications are hereby incorporated by reference herein.

FIELD OF THE INVENTION

The present invention relates to methods for diagnosing, monitoring or prognosticating prostate cancer or the progression state of prostate cancer wherein said method determines the state of the prostate cancer, based on the expression level of phosphodiesterase 4D (PDE4D) variants. The invention further relates to a method of identifying an individual for eligibility for prostate cancer therapy. The invention also relates to products for the analysis of phosphodiesterase 4D (PDE4D) variants as well as pharmaceutical compositions modulating the activity and/or expression of PDE4D variants.

BACKGROUND OF THE INVENTION

Cancer is a class of diseases in which a group of cells display uncontrolled growth, invasion and sometimes metastasis. These three malignant properties of cancers differentiate them from benign tumors, which are self-limited, do not invade or metastasize.

Prostate Cancer (PCa) is the most commonly occurring non-skin malignancy in men, with an estimated 900,000 new cases diagnosed world-wide in 2008. Due to ageing populations, the incidence of PCa will dramatically increase in the coming years. Routine diagnosis by determination of blood levels of the prostate-specific antigen (PSA), digital rectal exam (DRE) and transrectal ultrasound analysis (TRUS) leads to significant first-line over-diagnosis of non-cancerous, benign prostate conditions: of the approx. 1 million prostate biopsies annually performed in the U.S. alone to find about 250,000 new cases, about 75% are done unnecessarily, incurring both substantial complications (urosepsis, bleedings, urinary retention) in patients and total cost of >US$2 billion (~US$2,100 per biopsy procedure). At least 4 out of 100 men with a negative biopsy are likely to be hospitalized due to side-effects and 9 out of 10,000 biopsied patients are at risk of dying from the currently used procedure.

Of the approximately 250,000 newly detected PCa cases in the U.S. per year, about 200,000 are initially characterized as localized disease, i.e. as cancer confined to the prostate organ. This condition is to a certain extent curable by primary treatment approaches, such as radiation therapy or, in particular, the partial or total removal of the prostate by surgery (prostatectomy). However, these interventions typically come with serious side effects, particularly urinary incontinence and/or erectile dysfunctions as very frequent consequences of prostatectomy. Up to 50% of men undergoing radical prostatectomy develop urinary incontinence. Studies have shown that, one year after surgery, between 15% and 50% of men still report such problems. Erection problems likewise are serious side effects of radical prostatectomy (RP). Only about half of the operated men are able to regain some of their ability to have erections. Furthermore, all routinely applied treatments for localized PCa are expensive (typically in the order of US$20-30,000) and incur total direct costs of US$5 billion in the U.S. each year.

Among the ~200,000 men in the United States with clinically localized disease at diagnosis, up to 50% have very-low- or low-risk cancer. Accordingly, the NCCN (National Comprehensive Cancer Network) recently revised their PCa treatment guidelines to expand active surveillance (AS) as a gentle and convenient treatment alternative for patients with such low risk disease. By referring appropriate patients to AS, the quality of life for such patients is significantly improved as compared with men having undergone primary treatment and the 5-year cost for AS is reported to be less than US$10,000 per patient.

Moreover, in case surgery (vs. AS) is selected as the treatment of choice for a given patient, it is of significant advantage to stratify for the extent of surgery according to the potential aggressiveness of the patient's tumor. For instance, nerve-sparing operation techniques could be more generally applied for men with predicted low-risk disease to minimize potency-related adverse effects of radical prostatectomy. Likewise, according to the European Association Of Urology (EAU)'s latest Prostate Cancer Guidelines, extended lymph node dissection is recommended in case of a predicted high-risk cancer despite the fact that the procedure is complex, time-consuming and associated with higher complication rates as compared with more limited procedures. Consequently, while less limited lymph node dissection has shown to miss about 50% of lymph node metastases, the management of men with localized prostate cancer requires highly accurate pre-surgical predictions of the aggressiveness potential of an individual tumor to provide most optimal care for each patient.

WO 2010/131194 A1 discloses a method for diagnosing or detecting malignant, hormone sensitive prostate cancer comprising the step of determining the expression level of the phosphodiesterase 4D variant PDE4D7. The document also discloses the use of a PDE-Index to effectively discriminate between benign and malignant diseases, in which the expression of PDE4D7 is normalized against PDE4D5 as an internal control.

WO 2010/131195 A1 describes a method for diagnosing hormone resistant vs. hormone sensitive prostate cancer comprising the step of determining the expression level of PDE4D7. The PDE4D7 expression level is normalized to a reference gene, which may be PDE4D5.

The article, "The cAMP phosphodiesterase-4D7 (PDE4D7) is downregulated in androgen-independent prostate cancer cells and mediates proliferation by compartmentalizing cAMP at the plasma membrane of VCaP prostate cancer cells" by Henderson et al. in *British Journal of Cancer*, Volume 110, Number 5, pages 1278-1287, (2014), presents evidence for PDE4D7 being highly expressed in androgen sensitive prostate cancer cells while being significantly down-regulated in androgen insensitive prostate cancer cells and suggests a potential application as a biomarker for androgen insensitive prostate cancer as well as therapeutic possibilities.

EP 1471153 A2 is directed to a transcriptional activity assay for determining the biological activity of a compound by analyzing its capability to modulate gene expression. Among the possible target expression products are the PDE4D isoenzymes. The compounds identified in the described screenings may be antibodies, which are of therapeutic value in the treatment of e.g. breast cancer.

WO 2010/059838 A2 relates to inhibitors of phosphodiesterase-4 (PDE4) and their use in the treatment and prevention of stroke, myocardial infarct, cardiovascular inflammatory diseases and disorders as well as central nervous system disorders.

WO 2004/090157 A1 discloses the use of PDE4D, in particular PDE4D5 or PDE4D7 as a target for the identification of compounds that can be used for the treatment of atherosclerosis or for the treatment of restenosis.

US 2003/220273 A1 describes antisense compounds, compositions and methods for modulating the expression of phosphodiesterase 4D and the use of these compounds for treatment of diseases associated with expression of phosphodiesterase 4D.

The article, "Roles of cAMP and cAMP-dependent protein kinase in the progression of prostate cancer: Cross-talk with the androgen receptor" by Merkle and Hoffmann in *Cellular Signalling*, Volume 23, Number 3, pages 507-515, (2011) is a study on the roles of cAMP and cAMP-dependent protein kinase in the progression of prostate cancer. In the context of this study it is stated, that PDE4D expression is increased in cancer tissues.

SUMMARY OF THE INVENTION

The present invention relates to the identification and use of gene expression profiles, signatures, or patterns of biomarker genes of interest (also referred to as marker genes) with clinical relevance to prostate cancer. In particular, the invention is based on the gene expression analysis of nucleic acids, preferably transcripts of biomarker genes, obtained from biological samples. In particular, expression analysis of these marker genes is used in providing a prostate cancer PDE index (PDE-Index) indicative for the presence and/or absence of prostate cancer and/or the prostate cancer progression state.

Therefore, the PDE-Index provides a very helpful parameter for personalized medicine relating to the diagnosis, prognosis and treatment of prostate cancer patients. The PDE-Index may be used alone or in combination with other means and methods that provide information on the patients' personal disease status or disease stage.

Physicians and/or pathologists can advantageously use the PDE-Index to confirm results obtained in other methods for diagnosing, identifying, prognosticating patients. The methods and means provided by the invention therefore help establish better diagnosis, prognosis, etc. to find the best treatment for a patient, and to avoid unnecessary surgery or other treatments that are dangerous due to side-effects, occasionally superfluous and result in enormous costs for the public health systems.

One aspect of the invention is directed to a method comprising the step of:
  a) determining the presence or absence of prostate cancer and/or a prostate cancer progression state based on a gene expression profile including the expression level of at least two phosphodiesterase 4D (PDE4D) variants selected from the group consisting of PDE4D1, PDE4D2, PDE4D3, PDE4D4, PDE4D5, PDE4D6, PDE4D7, PDE4D8 and PDE4D9, and wherein none of the PDE4D variants serves as a reference gene.

Another aspect of the invention is directed to a method comprising the step of:
  a) determining the presence or absence of TMPRSS2-ERG gene fusion or the expression level of transcription factor ERG, based on a gene expression profile including the expression level of at least two phosphodiesterase 4D (PDE4D) variants selected from the group consisting of PDE4D1, PDE4D2, PDE4D3, PDE4D4, PDE4D5, PDE4D6, PDE4D7, PDE4D8 and PDE4D9, and wherein none of the PDE4D variants serves as a reference gene.

In some embodiments of any of the above aspects, the gene expression profile is converted into at least one prostate cancer PDE index (PDE-Index) indicative for the presence and/or absence of prostate cancer and/or the prostate cancer progression state. The introduction of the PDE-Index provides a good predication in prostate cancer diagnosis or prognosis or a good performance in clinical applications as described herein.

PDE4D variants not serving as a reference gene provides a good predication in prostate cancer diagnosis or prognosis or a good performance in clinical applications as described herein.

In some embodiments, the PDE4D variants are selected from the group consisting of PDE4D1, PDE4D2, PDE4D3, PDE4D4, PDE4D5, PDE4D6, PDE4D8 and PDE4D9. The selected genes provide a good predication in prostate cancer diagnosis or prognosis or a good performance in clinical applications as described herein.

In some embodiments, the gene expression profile is a gene expression profile of a sample, preferably a sample from an individual.

In some embodiments, the gene expression profile is a normalized gene expression profile which is obtained by normalizing the expression level of the PDE4D variants to the expression of at least one reference gene, the method optionally comprising, before the normalization, the step of determining the expression level of at least one reference gene in a sample.

In some embodiments, the methods as described herein are a method for diagnosing, monitoring or prognosticating prostate cancer or the progression state of prostate cancer.

In some embodiments, the methods as described herein further comprise identifying an individual as eligible to receive a prostate cancer therapy where the PDE-Index of the individual indicates the presence of prostate cancer or wherein the PDE-Index of the individual indicates a non-progressive or progressive prostate cancer progression state.

In some embodiments, the methods as described herein further comprise treating an individual eligible to receive a prostate cancer therapy.

In some embodiments, the methods as described herein further comprise, before step a), the step of determining the expression level of at least two phosphodiesterase 4D (PDE4D) variants selected from the group consisting of PDE4D1, PDE4D2, PDE4D3, PDE4D4, PDE4D5, PDE4D6, PDE4D7, PDE4D8 and PDE4D9 in a sample to obtain a gene expression profile. In one embodiment, the PDE4D variant is selected from the group consisting of PDE4D1, PDE4D2, PDE4D3, PDE4D4, PDE4D5, PDE4D6, PDE4D8 and PDE4D9.

In a further embodiment, the prostate cancer progression state is non-progressive or progressive.

In one embodiment, the expression level of PDE4D1 and PDE4D2 is determined for both variants together.

In another embodiment, the PDE4D variants are selected from the group comprising PDE4D5, PDE4D7 and PDE4D9, preferably comprising PDE4D1, PDE4D2, PDE4D4, PDE4D5, PDE4D7 and PDE4D9.

In one embodiment, in step (a) the expression level of at least three PDE4D variants is determined.

In some embodiments, the at least one PDE-Index is selected from the following:
i) PDE-Index_1:
PDE4D7_exp-PDE4D5_exp
ii) PDE-Index_2:
MEAN(PDE4D7_exp & PDE4D5_exp)
iii) PDE-Index_3:
(MEAN(PDE4D5_exp & PDE4D7_exp & PDE4D9_exp))/(PDE4D4_exp)
iv) PDE-Index_4:
(MEAN(PDE4D5_exp & PDE4D7_exp & PDE4D9_exp))/(PDE4D1&PDE4D2_exp)
v) PDE-Index_5:
(MEAN(PDE4D5_exp & PDE4D7_exp & PDE4D9_exp))

The calculation of the PDE-Index provides a good predication in prostate cancer diagnosis or prognosis or a good performance in clinical applications as described herein.

In an additional embodiment, PDE-Index_1 is determined in order to distinguish noncancerous prostate from cancerous prostate.

In another embodiment, at least one of PDE-Index_2, PDE-Index_3, PDE-Index_4 and PDE-Index_5 is determined in order to distinguish non-progressive from progressive prostate cancer, and/or wherein a PDE-Index_2, PDE-Index_3, PDE-Index_4 or PDE-Index_5 above a predetermined cutoff value is indicative for non-progressive prostate cancer progression state, and/or a PDE-Index_2, PDE-Index_3, PDE-Index_4 or PDE-Index_5 below the predetermined cutoff value is indicative for progressive prostate cancer progression state.

In a further embodiment, the presence of the fusion gene TMPRSS2-ERG fusion gene is determined and/or wherein the method is carried out with fusion gene TMPRSS2-ERG positive samples.

In one embodiment, determining of the expression level in step (a) is accomplished, or is additionally accomplished, by the measurement of nucleic acid or protein levels or by the determination of the biological activity of the PDE4D variant.

In one embodiment, determining of the expression level of the reference gene is accomplished, or is additionally accomplished, by the measurement of nucleic acid or protein levels or by the determination of the biological activity of at least one reference gene.

In some embodiments, the at least one reference gene is a housekeeping gene, preferably TBP, HPRT1, ACTB, RPLP0, PUM1, POLR2A, B2M, K-ALPHA-1 (=TUBA1B) or ALAS-1.

In some embodiments, the sample is a tissue sample, a urine sample, a urine sediment sample, a blood sample, a saliva sample, a semen sample, a sample comprising circulating tumor cells, a sample containing prostate secreted exosomes, or cell lines or cancer cell lines.

In another embodiment the methods as described herein comprise the additional step of determining pGleason score and/or pT stage.

In another embodiment the gene expression level is determined by detecting mRNA expression using one or more probes and/or one or more probe sets.

In a further embodiment the gene expression level is determined by an amplification based method and/or microarray analysis and/or RNA sequencing.

In an additional embodiment, the gene expression level is determined by RNA sequencing, PCR, qPCR or multiplex-PCR.

In a specific embodiment, an individual is identified as eligible to receive a prostate cancer therapy selected from prostate surgery, prostate removal, chemotherapy, radiotherapy, limited or extended lymph node dissection, where the PDE-Index of the individual's sample indicates a progressive prostate cancer progression state.

In a further embodiment, in step (c) an individual is identified as eligible to receive as prostate cancer therapy active surveillance where the PDE-Index of the individual's sample indicates a non-progressive prostate cancer progression state.

A further aspect of the invention is directed to a product comprising:
  primers and/or probes for determining the expression level of at least two phosphodiesterase 4D (PDE4D) variants selected from the group consisting of PDE4D1, PDE4D2, PDE4D3, PDE4D4, PDE4D5, PDE4D6, PDE4D7, PDE4D8 and PDE4D9;
  optionally further comprising primers and/or probes for determining the gene expression level of a reference gene, preferably a housekeeping gene, more preferably TBP, HPRT1, ACTB, RPLP0, PUM1, POLR2A, B2M, K-ALPHA-1 or ALAS-1.

The product provides a basis or input for performing the methods as described herein, which in turn provide a good predication in prostate cancer diagnosis or prognosis or a good performance in clinical applications as described herein.

In some embodiments, the product is a kit, including PCR kit, a RNA-sequencing kit, or a microarray kit. In another embodiment, the product is a microarray. The product provides an efficient way for obtaining the required expression levels.

In some embodiments, the product is a product for performing any of the methods, or the product is a product for diagnosing, monitoring or prognosticating prostate cancer or the progression state of prostate cancer or for identifying an individual for eligibility for prostate cancer therapy.

In some embodiments, the product is a composition comprising a set of nucleic acid molecules each comprising at least two oligonucleotide probe sequence for the analysis of the gene expression of the PDE4D variants PDE4D1, PDE4D2, PDE4D3, PDE4D4, PDE4D5, PDE4D6, PDE4D7, PDE4D8 and PDE4D9, optionally comprising at least one oligonucleotide probe sequence for the analysis of the gene expression of reference genes selected from TBP, HPRT1, ACTB, RPLP0, PUM1, POLR2A, B2M, K-ALPHA-1 (TUBA1B) or ALAS-1.

In some embodiments, the product is an nucleic acid array comprising one or more oligonucleotide probes complementary and hybridizable to a coding sequence of at least two PDE4D variants PDE4D1, PDE4D2, PDE4D3, PDE4D4, PDE4D5, PDE4D6, PDE4D7, PDE4D8 and PDE4D9, optionally comprising one or more oligonucleotide probes complementary and hybridizable to at least one of the reference genes selected from TBP, HPRT1, ACTB, RPLP0, PUM1, POLR2A, B2M, K-ALPHA-1 (TUBA1B) or ALAS-1, for determining a PDE-Index as defined in any of the preceding claims.

In some embodiments, the product is a kit for diagnosing, monitoring or prognosticating prostate cancer or the progression state of prostate cancer for identifying an individual for eligibility for prostate cancer therapy comprising: a) an array as defined in above, b) a kit control; and c) optionally instructions for use.

An additional aspect of the invention refers to a computer implemented method for diagnosing, monitoring or prognosticating prostate cancer or the progression state of prostate cancer, comprising the method steps as defined herein.

A further aspect of the invention relates to a computer program product, comprising computer readable code stored on a computer readable medium or downloadable from a communications network, which, when run on a computer, implement one or more steps or all the steps of any one of the methods as described herein.

A further aspect of the invention relates to a non-transitory computer readable storage medium with an executable program stored thereon, wherein the program instructs a microprocessor to perform one or more of the steps of any of the methods as described herein.

A yet further aspect of the invention relates to a system comprising the product as described herein and the computer program product or the non-transitory computer readable storage medium as described herein.

A still further aspect of the invention relates to a stimulatory pharmaceutical composition for use in the treatment or prevention of prostate cancer comprising at least one element selected from the group of:
(a) a compound directly stimulating or modulating the activity of a PDE4D variant selected from the group consisting of PDE4D1, PDE4D2, PDE4D3, PDE4D4, PDE4D5, PDE4D6, PDE4D8, PDE4D9, preferably an allosteric agonist of the enzymatic activity;
(b) a compound indirectly stimulating or modulating the activity of the PDE4D variant of (a);
(c) the protein of the PDE4D variant of (a) or a biologically active equivalent thereof;
(d) a nucleic acid encoding and expressing the PDE4D variant of (a);
(e) a miRNA inhibitor specific for miRNAs of the PDE4D variant of (a);
(f) a demethylation agent; and
(g) a phosphodiesterase displacement factor, preferably a peptide, a
peptidomimetic, a small molecule, an antibody or an aptamer, wherein the PDE4D variant is preferably selected from the group consisting of PDE4D5, PDE4D8, PDE4D9.

A yet further aspect of the invention relates to an inhibitory pharmaceutical composition for use in the treatment or prevention of prostate cancer comprising at least one element selected from the group of:
(a) a compound directly inhibiting the activity of a PDE4D variant selected from the group consisting of PDE4D1, PDE4D2, PDE4D3, PDE4D4, PDE4D5, PDE4D6, PDE4D8, PDE4D9,
(b) a compound indirectly inhibiting the activity of the PDE4D variant of (a);
(c) a dominant negative form of the protein of the PDE4D variant of (a) or a biologically active equivalent thereof;
(d) a nucleic acid encoding and expressing a dominant negative form of the PDE4D variant of (a);
(e) a miRNA specific for the PDE4D variant of (a);
(f) an antisense molecule for the PDE4D variant of (a);
(g) a siRNA specific for the PDE4D variant of (a);
(h) an aptamer specific for the expression product of the PDE4D variant of (a) or for the protein of the PDE4D variant of (a);
(i) a small molecule or peptidomimetic capable of specifically binding to the protein of the PDE4D variant of (a); and
(j) an antibody specific for the protein of the PDE4D variant of (a) and/or an antibody variant specific for the protein of the PDE4D variant of (a).

wherein the PDE4D variant is preferably selected from the group consisting of PDE4D5, PDE4D8, PDE4D9.

The pharmaceutical compositions as described herein provide an effective approach to treat a range of prostate cancer.

In some embodiments, the PDE4D variant is selected from the group consisting of PDE4D5, PDE4D8, PDE4D9.

In some embodiments, the stimulatory or inhibitory pharmaceutical composition is for the treatment of prostate cancer, wherein the composition is administered to an individual in dependence of the PDE-Index indicative for the prostate cancer progression state.

In some embodiments, the stimulatory or inhibitory pharmaceutical composition is for the treatment of prostate cancer, wherein the composition is administered to an individual where the PDE-Index of the individual's sample indicates a progressive prostate cancer progression state.

In some embodiments, the stimulatory or inhibitory pharmaceutical composition is for the treatment of prostate cancer, wherein least one of PDE-Index_2, the PDE-Index_3, the PDE-Index_4 or the PDE-Index_5 of the individual's sample is below a predetermined threshold.

A further aspect of the invention relates to a method for treating a subject having prostate cancer, the method comprising
(i) selecting a subject having prostate cancer where the PDE-Index of the individual's sample indicates a progressive prostate cancer progression state, and
(ii) administering the stimulatory or inhibitory pharmaceutical composition as described herein to the selected subject.

The method provides an effective approach to treat a range of prostate cancer.

In some embodiments, the method comprises:
(i) selecting a subject having prostate cancer, where at least one of PDE-Index_2, the PDE-Index_3, the PDE-Index_4, or the PDE-Index_5 of the individual's sample is below a predetermined threshold, and
(ii) administering the stimulatory or inhibitory pharmaceutical composition as described herein to the selected subject.

A further aspect of the invention relates to PDE4D variant selected from the group comprising of PDE4D1, PDE4D2, PDE4D3, PDE4D4, PDE4D5, PDE4D6, PDE4D8 and PDE4D9 for use as a marker for the presence of prostate cancer or for the prostate cancer progression state.

A still further aspect of the invention relates to the use of a PDE4D variant selected from the group comprising of PDE4D1, PDE4D2, PDE4D3, PDE4D4, PDE4D5, PDE4D6, PDE4D8 and PDE4D9 for diagnosing, monitoring or prognosticating prostate cancer or the progression state of prostate cancer.

BRIEF DESCRIPTION OF THE DRAWINGS

FIG. 1 shows the probes sets of the Affymetrix Human Exon 1.0 ST Array with the NCBI gene Reference Sequence (NM_001197222.1; NM_001197221.1; NM_006203.4; NM_001104631.1; NM_001197218.1; NM_001197223.1; NM_001165899.1; NM 001197219.1; and NM 001197220.1) and the NCPI protein accession number of the corresponding PDE4D variant as well as primer and probe sequences specific for the PDE4D variant. Further, SEQ ID NOs of PDE4D1 include 1 or 2; SEQ ID NOs of PDE4D2 include 3 or 4; of PDE4D3 include 5 or 6; SEQ ID NOs of PDE4D4 include 7 or 8; SEQ ID NOs of PDE4D5 include 9 or 10; SEQ ID NOs of PDE4D6 include 11 or 12; SEQ ID NOs of PDE4D7 include 13 or 14; SEQ ID NOs of PDE4D8 include 15 or 16; and SEQ ID NOs of PDE4D9 include 17 or 18.

FIG. 2 lists reference genes with their Transcript ID, Protein ID, SEQ ID NOs mRNA (32, 33 and 34) and SEQ ID NOs Protein (44, 45 and 46) as well as primer and probe sequences specific for the reference genes.

FIG. 3 shows the performance of PDE4D1 to PDE4D9 and PDE-Index_1 to PDE-Index_5 for discriminating non-cancerous tissue, non-progressing and progressing prostate cancer.

FIG. 4 shows the performance results of PDE4D1 to PDE4D9 and PDE-Index_1 to PDE-Index_5 for discriminating noncancerous tissue and non-progressing prostate cancer.

FIG. 5 shows the performance results of the PDE-Index_1. An overview over in total eight prostate cancer data sets comprising in total >900 patient samples from the categories of normal adjacent tissue, benign lesions, benign hyperplasia, as well as tumour tissue is provided.

FIG. 6 shows the performance results of PDE-Index_2, PDE-Index_3, PDE-Index_4 and PDE-Index_5 for discriminating non-progressing and progressing prostate tumor samples.

FIG. 7 shows the performance results of PDE4D1 to PDE4D9 and PDE-Index_1 to PDE-Index_5 for discriminating noncancerous tissue and non-progressing prostate tumor samples.

FIG. 8 the correlation of the PDE4D1 to PDE4D9 and PDE-Index_1 to PDE-Index_5 and pathology Gleason score in a prostate cancer set is shown.

FIG. 9 gives an overview of the added value of PDE4D1 to PDE4D9 and PDE-Index_1 to PDE-Index_5 together with clinical data on the progression free survival depending on the TMPRSS2-ERG fusion status of the tumor.

DETAILED DESCRIPTION OF EMBODIMENTS

Figure 10:
FIG. 10 shows the normalized expression of PDE4D1/2, PDE4D3, PDE4D4 and PDE4D5 across six different prostate cancer tissue types in the data set Taylor et al., Integrative Genome Profiling of Human Prostate Cancer, Cancer Cell 18, 11-22, 2010 (GSE21034 (NCBI GEO)).

Although the present invention will be described with respect to particular embodiments, this description is not to be construed in a limiting sense.

Before describing in detail exemplary embodiments of the present invention, definitions important for understanding the present invention are given.

As used in this specification and in the appended claims, the singular forms of "a" and "an" also include the respective plurals unless the context clearly dictates otherwise.

In the context of the present invention, the terms "about" and "approximately" denote an interval of accuracy that a person skilled in the art will understand to still ensure the technical effect of the feature in question. The term typically indicates a deviation from the indicated numerical value of ±20%, preferably ±15%, more preferably ±10%, and even more preferably ±5%.

It is to be understood that the term "comprising" is not limiting. For the purposes of the present invention the term "consisting of" is considered to be a preferred embodiment of the term "comprising of". If hereinafter a group is defined to comprise at least a certain number of embodiments, this is meant to also encompass a group which preferably consists of these embodiments only.

Furthermore, the terms "first", "second", "third" or "(a)", "(b)", "(c)", "(d)" etc. and the like in the description and in the claims, are used for distinguishing between similar elements and not necessarily for describing a sequential or chronological order. It is to be understood that the terms so used are interchangeable under appropriate circumstances and that the embodiments of the invention described herein are capable of operation in other sequences than described or illustrated herein.

In case the terms "first", "second", "third" or "(a)", "(b)", "(c)", "(d)" etc. relate to steps of a method or use there is no time or time interval coherence between the steps, i.e. the steps may be carried out simultaneously or there may be time intervals of seconds, minutes, hours, days, weeks, months or even years between such steps, unless otherwise indicated in the application as set forth herein above or below. It is to be understood that this invention is not limited to the particular methodology, protocols, proteins, bacteria, vectors, reagents etc. described herein as these may vary. It is also to be understood that the terminology used herein is for the purpose of describing particular embodiments only, and is not intended to limit the scope of the present invention that will be limited only by the appended claims. Unless defined otherwise, all technical and scientific terms used herein have the same meanings as commonly understood by one of ordinary skill in the art.

One aspect of the invention is directed to a method comprising the step of:
a) determining the presence or absence of prostate cancer and/or a prostate cancer progression state based on a gene expression profile including the expression level of at least two phosphodiesterase 4D (PDE4D) variants selected from the group consisting of PDE4D1, PDE4D2, PDE4D3, PDE4D4, PDE4D5, PDE4D6, PDE4D7, PDE4D8 and PDE4D9, and wherein none of the PDE4D variants serves as a reference gene.

Another aspect of the invention is directed to a method comprising the step of:
a) determining the presence or absence of TMPRSS2-ERG gene fusion or the expression level of transcription factor ERG, based on a gene expression profile including the expression level of at least two phosphodiesterase 4D (PDE4D) variants selected from the group consisting of PDE4D1, PDE4D2, PDE4D3, PDE4D4, PDE4D5, PDE4D6, PDE4D7, PDE4D8 and PDE4D9, and wherein none of the PDE4D variants serves as a reference gene.

The term "PDE4D transcript variant" or "PDE4D isoform" or "PDE4D variant" relates to any of the PDE4D splice variants of the human phosphodiesterase PDE4D, i.e.

the human phosphodiesterase PDE4D gene, for example PDE4D1, PDE4D2, PDE4D3, PDE4D4, PDE4D5, PDE4D6, PDE4D7, PDE4D8 and PDE4D9.

The terms "marker" "maker gene" "GOI" or "PDE4D variant marker", can be used interchangeably and relate to a gene, genetic unit or sequence (a nucleotide sequence or amino acid or protein sequence) as defined herein above, whose expression level is increased or decreased in malignant or benign, prostate cancer cell or tissue or in any type of sample comprising such cells or tissues or portions or fragments thereof, when comparing to a control level, preferably when comparing to the expression in normal tissue. The term also refers to any expression product of said genetic unit or sequence, in particular to a PDE4D variant mRNA transcript, a polypeptide or protein encoded by the PDE4D variant transcript or fragments thereof, as well as homologous derivatives thereof as described herein above. In particular, the terms "marker" "maker gene" "GOI" or "PDE4D variant marker" refer to any of the PDE4D splice variants of the human phosphodiesterase PDE4D, i.e. the human phosphodiesterase PDE4D gene, for example PDE4D1, PDE4D2, PDE4D3, PDE4D4, PDE4D5, PDE4D6, PDE4D7, PDE4D8 and PDE4D9.

The term "phosphodiesterase 4D1" or "PDE4D1" relates to the splice variant 1 of the human phosphodiesterase PDE4D, i.e. the human phosphodiesterase PDE4D1 gene, preferably to the sequence as defined in NCBI Reference Sequence: NM_001197222.1, more preferably to the nucleotide sequence as set forth in SEQ ID NO: 1, which corresponds to the sequence of the above indicated NCBI Reference Sequence of the PDE4D1 transcript, and also relates to the corresponding amino acid sequence as set forth in SEQ ID NO: 2, which corresponds to the protein sequence defined in NCBI Protein Accession Reference Sequence NP_001184151.1 encoding the PDE4D1 polypeptide. The term "phosphodiesterase 4D1" or "PDE4D1" also relates to the amplicon that can be generated by the primer pair PDE1D1D2_forward (SEQ ID NO: 20) and the PDE1D1D2_reverse (SEQ ID NO: 21) and can be detected by probe SEQ ID NO: 22.

The term "phosphodiesterase 4D2" or "PDE4D2" relates to the splice variant 2 of the human phosphodiesterase PDE4D, i.e. the human phosphodiesterase PDE4D2 gene, preferably to the sequence as defined in NCBI Reference Sequence: NM_001197221.1, more preferably to the nucleotide sequence as set forth in SEQ ID NO: 3, which corresponds to the sequence of the above indicated NCBI Reference Sequence of the PDE4D2 transcript, and also relates to the corresponding amino acid sequence as set forth in SEQ ID NO: 4, which corresponds to the protein sequence defined in NCBI Protein Accession Reference Sequence NP_001184150.1 encoding the PDE4D2 polypeptide. The term "phosphodiesterase 4D2" or "PDE4D2" also relates to the amplicon that can be generated by the primer pair PDE1D1D2_forward (SEQ ID NO: 20) and the PDE1D1D2_reverse (SEQ ID NO: 21) and can be detected by probe SEQ ID NO: 22.

The term "phosphodiesterase 4D3" or "PDE4D3" relates to the splice variant 3 of the human phosphodiesterase PDE4D, i.e. the human phosphodiesterase PDE4D3 gene, preferably to the sequence as defined in NCBI Reference Sequence: NM_006203.4, more preferably to the nucleotide sequence as set forth in SEQ ID NO: 5, which corresponds to the sequence of the above indicated NCBI Reference Sequence of the PDE4D3 transcript, and also relates to the corresponding amino acid sequence as set forth in SEQ ID NO: 6, which corresponds to the protein sequence defined in NCBI Protein Accession Reference Sequence NP_006194.2 encoding the PDE4D3 polypeptide.

The term "phosphodiesterase 4D4" or "PDE4D4" relates to the splice variant 4 of the human phosphodiesterase PDE4D, i.e. the human phosphodiesterase PDE4D4 gene, preferably to the sequence as defined in NCBI Reference Sequence: NM_001104631.1, more preferably to the nucleotide sequence as set forth in SEQ ID NO: 7, which corresponds to the sequence of the above indicated NCBI Reference Sequence of the PDE4D4 transcript, and also relates to the corresponding amino acid sequence as set forth in SEQ ID NO: 8, which corresponds to the protein sequence defined in NCBI Protein Accession Reference Sequence NP_001098101.1 encoding the PDE4D4 polypeptide.

The term "phosphodiesterase 4D5" or "PDE4D5" relates to the splice variant 5 of the human phosphodiesterase PDE4D, i.e. the human phosphodiesterase PDE4D5 gene, preferably to the sequence as defined in NCBI Reference Sequence: NM_001197218.1, more preferably to the nucleotide sequence as set forth in SEQ ID NO: 9, which corresponds to the sequence of the above indicated NCBI Reference Sequence of the PDE4D5 transcript, and also relates to the corresponding amino acid sequence as set forth in SEQ ID NO: 10, which corresponds to the protein sequence defined in NCBI Protein Accession Reference Sequence NP_001184147.1 encoding the PDE4D5 polypeptide. The term "phosphodiesterase 4D5" or "PDE4D5" also relates to the amplicon that can be generated by the primer pair PDE1D5_forward (SEQ ID NO: 23) and the PDE1D5_reverse (SEQ ID NO: 24) and can be detected by probe SEQ ID NO: 25.

The term "phosphodiesterase 4D6" or "PDE4D6" relates to the splice variant 6 of the human phosphodiesterase PDE4D, i.e. the human phosphodiesterase PDE4D6 gene, preferably to the sequence as defined in NCBI Reference Sequence: NM_001197223.1, more preferably to the nucleotide sequence as set forth in SEQ ID NO: 11, which corresponds to the sequence of the above indicated NCBI Reference Sequence of the PDE4D6 transcript, and also relates to the corresponding amino acid sequence as set forth in SEQ ID NO: 12, which corresponds to the protein sequence defined in NCBI Protein Accession Reference Sequence NP_001184152.1 encoding the PDE4D6 polypeptide.

The term "phosphodiesterase 4D7" or "PDE4D7" relates to the splice variant 7 of the human phosphodiesterase PDE4D, i.e. the human phosphodiesterase PDE4D7 gene, preferably to the sequence as defined in NCBI Reference Sequence: NM_001165899.1, more preferably to the nucleotide sequence as set forth in SEQ ID NO: 13, which corresponds to the sequence of the above indicated NCBI Reference Sequence of the PDE4D7 transcript, and also relates to the corresponding amino acid sequence as set forth in SEQ ID NO: 14, which corresponds to the protein sequence defined in NCBI Protein Accession Reference Sequence NP_001159371.1 encoding the PDE4D7 polypeptide. The term "phosphodiesterase 4D7" or "PDE4D7" also relates to the amplicon that can be generated by the primer pair PDE1D7_forward (SEQ ID NO: 26) and the PDE1D7_reverse (SEQ ID NO: 27) and can be detected by probe SEQ ID NO: 28.

The term "phosphodiesterase 4D8" or "PDE4D8" relates to the splice variant 8 of the human phosphodiesterase PDE4D, i.e. the human phosphodiesterase PDE4D8 gene, preferably to the sequence as defined in NCBI Reference Sequence: NM_001197219.1, more preferably to the nucleotide sequence as set forth in SEQ ID NO: 15, which corresponds to the sequence of the above indicated NCBI Reference Sequence of the PDE4D8 transcript, and also relates to the corresponding amino acid sequence as set forth in SEQ ID NO: 16, which corresponds to the protein sequence defined in NCBI Protein Accession Reference Sequence NP_001184148.1 encoding the PDE4D8 polypeptide.

The term "phosphodiesterase 4D9" or "PDE4D9" relates to the splice variant 9 of the human phosphodiesterase PDE4D, i.e. the human phosphodiesterase PDE4D9 gene, preferably to the sequence as defined in NCBI Reference Sequence: NM_001197220.1, more preferably to the nucleotide sequence as set forth in SEQ ID NO: 17, which corresponds to the sequence of the above indicated NCBI Reference Sequence of the PDE4D9 transcript, and also relates to the corresponding amino acid sequence as set forth in SEQ ID NO: 18, which corresponds to the protein sequence defined in NCBI Protein Accession Reference Sequence NP_001184149.1 encoding the PDE4D9 polypeptide. The term "phosphodiesterase 4D9" or "PDE4D9" also relates to the amplicon that can be generated by the primer pair PDE1D5_forward (SEQ ID NO: 29) and the PDE1D5_reverse (SEQ ID NO: 30) and can be detected by probe SEQ ID NO: 31.

The terms "PDE4D1", "PDE4D2", "PDE4D3", "PDE4D4", "PDE4D5", "PDE4D6", "PDE4D7", "PDE4D8" and "PDE4D9" also comprises nucleotide sequences showing a high degree of homology to PDE4D1, PDE4D2, PDE4D3, PDE4D4, PDE4D5, PDE4D6, PDE4D7, PDE4D8 and PDE4D9 respectively, e.g. nucleic acid sequences being at least 75%, 80%, 85%, 90%, 91%, 92%, 93%, 94%, 95%, 96%, 97%, 98% or 99% identical to the sequence as set forth in SEQ ID NOs: 1, 3, 5, 7, 9, 11, 13, 15 or 17 respectively or amino acid sequences being at least 75%, 80%, 85%, 90%, 91%, 92%, 93%, 94%, 95%, 96%, 97%, 98% or 99% identical to the sequence as set forth in SEQ ID NO: 2, 4, 6, 8, 10, 12, 14, 16 or 18 respectively or nucleic acid sequences encoding amino acid sequences being at least 75%, 80%, 85%, 90%, 91%, 92%, 93%, 94%, 95%, 96%, 97%, 98% or 99% identical to the sequence as set forth in SEQ ID NO: 2, 4, 6, 8, 10, 12, 14, 16 or 18 or amino acid sequences being encoded by nucleic acid sequences being at least 75%, 80%, 85%, 90%, 91%, 92%, 93%, 94%, 95%, 96%, 97%, 98% or 99% identical to the sequence as set forth in SEQ ID NO: 1, 3, 5, 7, 9, 11, 13, 15 or 17.

The term "expression level" as used herein refers to the amount of PDE4D variant transcript and/or PDE4D protein derivable from a defined number of cells or a defined tissue portion, preferably to the amount of PDE4D variant transcript and/or PDE4D variant protein obtainable in a standard nucleic acid (e.g. RNA) or protein extraction procedure. Suitable extraction methods are known to the person skilled in the art.

The term "control level" (or "control state"), as used herein, relates to an expression level which may be determined at the same time and/or under similar or comparable conditions as the test sample by using (a) sample(s) previously collected and stored from a subject/subjects whose condition or disease state, e.g. non-cancerous, normal or benign prostate tumor, advanced prostate cancer etc. is/are known. The term "disease state" or "cancerous disease state" relates to any state or type of cellular or molecular condition between a non-cancerous cell state and (including) a terminal cancerous cell state. Preferably, the term includes different cancerous proliferation/developmental stages or levels of tumor development in the organism between (and excluding) a non-cancerous cell state and (including) a terminal cancerous cell state. Such developmental stages may include all stages of the TNM (Tumor, Node, Metastasis) classification system of malignant tumors as defined by the UICC, e.g. stages 0 and I to IV. The term also includes stages before TNM stage 0, e.g. developmental stages in which cancer biomarkers known to the person skilled in the art show a modified expression or expression pattern.

The expression level as mentioned above may preferably be the expression level of PDE4D variants as defined herein above. Alternatively or additionally, the expression level may also be the expression level of any other suitable gene or genetic element expressed in a cell e.g. the expression level of a housekeeping gene or the expression level of a combination of housekeeping genes, e.g. TBP, HPRT1, ACTB, RPLP0, PUM1, POLR2A, B2M, K-ALPHA-1 (=TUBA1B) or ALAS-1. In a preferred embodiment the expression level is determined for a combination of reference genes.

In another preferred embodiment the combination of reference genes comprises TBP, HPRT1 and at least one, at least two or at least three additional reference genes selected from the group comprising ACTB, RPLP0, PUM1, POLR2A, B2M, K-ALPHA-1 or ALAS-1.

In another preferred embodiment the combination of reference genes comprises TBP, HPRT1 and at least two additional reference genes selected from the group comprising ACTB, RPLP0, PUM1, K-ALPHA-1 or ALAS-1.

A particularly preferred combination is TBP, HPRT1, ACTB, RPLP0. Another particularly preferred combination is TBP, HPRT1, PUM1, K-ALPHA-1, ALAS-1.

The term "cancerous" relates in the context of the present invention to a cancerous disease state as defined herein.

The term "non-cancerous" relates in the context of the present invention to a condition in which neither benign nor malign proliferation can be detected. Suitable means for said detection are known in the art.

A preferred control level in the context of the present invention is the expression of the PDE4D variant in normal, i.e. healthy or non-cancerous tissue or the expression of PDE4D variant in benign prostate tumor tissue. The term "benign prostate tumor" as used herein refers to a prostate tumor which lacks all three of the malignant properties of a cancer, i.e. does not grow in an unlimited, aggressive manner, does not invade surrounding tissues, and does not metastasize. Typically, a benign prostate tumor implies a mild and non-progressive prostate neoplastic or swelling disease lacking the invasive properties of a cancer. Furthermore, benign prostate tumors are typically encapsulated, and thus inhibited in their ability to behave in a malignant manner. A benign tumor or a healthy condition may be determined by any suitable, independent molecular, histological or physiological method known to the person skilled in the art.

A more preferred control level in the context of the present invention is the expression of the PDE4D variant in normal, i.e. healthy or non-cancerous tissue or the expression of PDE4D variant in non-progressive prostate tumor tissue.

The expression control level may be determined by a statistical method based on the results obtained by analyzing previously determined expression level(s) of the marker gene(s) of the present invention in samples from patients whose disease state is known. Furthermore, the control level can be derived from a database of expression patterns or expression levels from previously tested patients, tissues or cells. The control level can be determined from a reference sample derived from a patient who has been diagnosed to suffer from prostate cancer, e.g. from hormone-independent or hormone-resistant prostate cancer. Moreover, the expression level of the marker genes of the present invention in a biological sample to be tested may be compared to multiple control levels, whose control levels are determined from multiple reference samples. It is contemplated to use a control level determined from a reference sample derived from a tissue type similar to that of the patient-derived biological sample. It is particularly preferred to use sample(s) derived from a patient whose disease state is cancerous as defined herein above.

Alternatively, reference samples may comprise material derived from cell lines, e.g. immortalized cancer cell lines, or be derived from tissue xenografts. Preferably, material derived from prostate cancer cell lines or material derived from tissue xenografts with human prostate tissue, in particular with benign and tumor-derived human prostate tissue, may be comprised in a reference sample according to the present invention. Examples of preferred cancer cell lines comprise cells lines PC346P, PC346B, LNCaP, VCaP, DuCaP, PC346C, PC3, DU145, PC346CDD, PC346Flu1, PC346Flu2. Examples of preferred xenografts comprise PC295, PC310, PC-EW, PC82, PC133, PC135, PC324 and PC374. Preferably an entire panel of cell lines and xenografts may be used, e.g. the human PC346 panel.

In a further, preferred alternative, reference samples may be derived from patient tissues, or tissue panels or tissue collections obtained in clinical environments. The samples may, for example, be obtained from male patients undergoing surgery. The samples may be derived from any suitable tissue type, e.g. from prostate tissue or lymph nodes. Preferred examples of patient tissue collections are derived from surgical procedures (e.g., prostatectomy).

Moreover, it is preferred to use the standard value of the expression levels of the PDE4D variant marker of the present invention in a population with a known disease state, e.g. a population having non-progressive prostate tumor or a healthy population. The standard value may be obtained by any method known in the art. For example, a range of mean±2 SD (standard deviation) or mean±3 SD may be used as standard value.

Furthermore, the control level may also be determined at the same time and/or under similar or comparable conditions as the test sample by using (a) sample(s) previously collected and stored from a subject/subjects whose disease state is/are known to be cancerous, i.e. who have independently been diagnosed to suffer from prostate cancer, in particular malignant, hormone-sensitive prostate cancer.

In the context of the present invention, a control level determined from a biological sample that is known not to be cancerous, e.g. is a healthy tissue sample or a non-progressive prostate tumor sample, is called "normal control level".

If the control level is determined from a cancerous biological sample, in particular a sample from a subject for which hormone-resistant cancer was diagnosed independently, it may be designated as "cancerous control level".

The term "prostate cancer" relates to a cancer of the prostate gland in the male reproductive system, which occurs when cells of the prostate mutate and begin to multiply out of control. Typically, prostate cancer is linked to an elevated level of prostate-specific antigen (PSA). In one embodiment of the present invention the term "prostate cancer" relates to a cancer showing PSA levels above 4.0. In another embodiment the term relates to cancer showing PSA levels above 2.0. The term "PSA level" refers to the concentration of PSA in the blood in ng/ml.

The term "non-progressive prostate cancer state" means that a sample of an individual does not show parameter values indicating "biochemical recurrence" and/or "clinical recurrence".

The term "progressive prostate cancer state" means that a sample of an individual shows parameter values indicating "biochemical recurrence" and/or "clinical recurrence".

In the context of the present application, the expression "biochemical recurrence" refers, e.g. to recurrent biological values of increased PSA indicating the presence of prostate cancer cells in a sample. However, it is also possible to use other markers that can be used in the detection of the presence or that rise suspicion of such presence.

In the context of the present application, the term "clinical recurrence" refers to the presence of clinical signs indicating the presence of tumor cells as measured, for example using in vivo imaging.

The term "increased" or "increased expression level" or "up-regulated expression level" or "increase of expression level" (which may be used synonymously) in the context of the present invention thus denotes a raise in the expression level between a situation to be analyzed, e.g. a situation derivable from a patient's sample, and a reference point, which could either be a normal control level or cancerous control level derivable from any suitable prostate tumor or cancer stage known to the person skilled in the art. Expression levels are deemed to be "increased" when the PDE4D variant gene expression, e.g. in a sample to be analyzed, differs by, i.e. is elevated by, for example, 5%, 6%, 7%, 8%, 9%, 10%, 15%, 20%, 25%, 30%, 40%, 50%, or more than 50% in comparison to a control level, or by at least 0.1 fold, at least 0.2 fold, at least 1 fold, at least 2 fold, at least 5 fold, or at least 10 fold or more in comparison to a control level. The control level may either be a normal control level or a cancerous control level as defined herein above. If a comparison with a cancerous control level is to be carried out, an additional comparison with a normal control level is preferred. Such an additional comparison allows for the determination of a tendency of the modification, e.g. the magnitude of an increase of the expression level may be observed and/or corresponding conclusions may be drawn. Preferred is a comparison to a benign prostate tumor, or to a healthy tissue or a sample derived from a healthy individual.

In a further embodiment, an additional similarity in the overall gene expression pattern between a sample obtained from a subject and a reference as defined herein above, which is cancerous, indicates that the subject is suffering from prostate cancer. In another embodiment of the present invention, the diagnosis may be combined with the elucidation of additional cancer biomarker expression levels, in particular prostate cancer biomarkers. Suitable biomarkers, in particular prostate cancer biomarker, would be known to the person skilled in the art. For example, the expression of biomarkers like PSA may be tested.

A malignant, hormone-sensitive prostate cancer may be considered as being diagnosed when the expression level of the PDE4D variant marker of the present invention is increased, compared to the normal control level as defined herein above.

A progressive cancer may be indicated if the PDE4D1 expression level, as defined herein above, is decreased by a value of between 20% to 80%, preferably by a value of 30%, 40%, 50%, 60% or 70% in a test sample in comparison to a control level. The control level may either be a normal control level or a cancerous control level, as defined herein above. In a particularly preferred embodiment a progressive prostate cancer may be indicated if the PDE4D1 expression level, as defined herein above, is decreased by a factor of 1.5- to 10-fold, preferably by a factor of 2- to 5-fold in a test sample in comparison to a normal control level, in particular a healthy tissue or a non-progressive prostate tumor.

A progressive cancer may be indicated if the PDE4D2 expression level, as defined herein above, is decreased by a value of between 20% to 80%, preferably by a value of 30%, 40%, 50%, 60% or 70% in a test sample in comparison to a control level. The control level may either be a normal control level or a cancerous control level, as defined herein above. In a particularly preferred embodiment a progressive prostate cancer may be considered as being diagnosed if the PDE4D2 expression level, as defined herein above, is decreased by a factor of 1.5- to 10-fold, preferably by a factor of 2- to 5-fold in a test sample in comparison to a normal control level, in particular a healthy tissue or a non-progressive prostate tumor.

A progressive cancer may be indicated if the PDE4D3 expression level, as defined herein above, is decreased by a value of between 20% to 80%, preferably by a value of 30%, 40%, 50%, 60% or 70% in a test sample in comparison to a control level. The control level may either be a normal control level or a cancerous control level, as defined herein above. In a particularly preferred embodiment a progressive prostate cancer may be indicated if the PDE4D3 expression level, as defined herein above, is decreased by a factor of 1.5- to 10-fold, preferably by a factor of 2- to 5-fold in a test sample in comparison to a normal control level, in particular a healthy tissue or a non-progressive prostate tumor.

A progressive cancer may be indicated if the PDE4D4 expression level, as defined herein above, is decreased by a value of between 20% to 80%, preferably by a value of 30%, 40%, 50%, 60% or 70% in a test sample in comparison to a control level. The control level may either be a normal control level or a cancerous control level, as defined herein above. In a particularly preferred embodiment a progressive prostate cancer may be indicated if the PDE4D4 expression level, as defined herein above, is decreased by a factor of 1.5- to 10-fold, preferably by a factor of 2- to 5-fold in a test sample in comparison to a normal control level, in particular a healthy tissue or a non-progressive prostate tumor.

A progressive cancer may be indicated if the PDE4D5 expression level, as defined herein above, is decreased by a value of between 20% to 80%, preferably by a value of 30%, 40%, 50%, 60% or 70% in a test sample in comparison to a control level. The control level may either be a normal control level or a cancerous control level, as defined herein above. In a particularly preferred embodiment a progressive prostate cancer may be indicated if the PDE4D5 expression level, as defined herein above, is decreased by a factor of 1.5- to 10-fold, preferably by a factor of 2- to 5-fold in a test sample in comparison to a normal control level, in particular a healthy tissue or a non-progressive prostate tumor.

A progressive cancer may be indicated if the PDE4D6 expression level, as defined herein above, is decreased by a value of between 20% to 80%, preferably by a value of 30%, 40%, 50%, 60% or 70% in a test sample in comparison to a control level. The control level may either be a normal control level or a cancerous control level, as defined herein above. In a particularly preferred embodiment a progressive prostate cancer may be indicated if the PDE4D6 expression level, as defined herein above, is decreased by a factor of 1.5- to 10-fold, preferably by a factor of 2- to 5-fold in a test sample in comparison to a normal control level, in particular a healthy tissue or a non-progressive prostate tumor.

A progressive cancer may be indicated if the PDE4D7 expression level, as defined herein above, is decreased by a value of between 20% to 80%, preferably by a value of 30%, 40%, 50%, 60% or 70% in a test sample in comparison to a control level. The control level may either be a normal control level or a cancerous control level, as defined herein above. In a particularly preferred embodiment a progressive prostate cancer may be indicated if the PDE4D7 expression level, as defined herein above, is decreased by a factor of 1.5- to 10-fold, preferably by a factor of 2- to 5-fold in a test sample in comparison to a normal control level, in particular a healthy tissue or a non-progressive prostate tumor.

A progressive cancer may be indicated if the PDE4D8 expression level, as defined herein above, is decreased by a value of between 20% to 80%, preferably by a value of 30%, 40%, 50%, 60% or 70% in a test sample in comparison to a control level. The control level may either be a normal control level or a cancerous control level, as defined herein above. In a particularly preferred embodiment a progressive prostate cancer may be indicated if the PDE4D8 expression level, as defined herein above, is decreased by a factor of 1.5- to 10-fold, preferably by a factor of 2- to 5-fold in a test sample in comparison to a normal control level, in particular a healthy tissue or a non-progressive prostate tumor.

A progressive cancer may be indicated if the PDE4D9 expression level, as defined herein above, is decreased by a value of between 20% to 80%, preferably by a value of 30%, 40%, 50%, 60% or 70% in a test sample in comparison to a control level. The control level may either be a normal control level or a cancerous control level, as defined herein above. In a particularly preferred embodiment a progressive prostate cancer may be indicated if the PDE4D9 expression level, as defined herein above, is decreased by a factor of 1.5- to 10-fold, preferably by a factor of 2- to 5-fold in a test sample in comparison to a normal control level, in particular a healthy tissue or a non-progressive prostate tumor.

A non-progressive prostate cancer progression stage may be detected when the expression level of the PDE4D7 marker is increased in comparison to the normal control level as defined herein above. In a preferred embodiment of the present invention a non-progressive prostate cancer may be detected if the expression level of the PDE4D7 marker is similar to an expression level of an established, e.g. independently established, prostate cancer cell or cell line, e.g. a non-progressive cancer cell line.

A progressive prostate cancer progression stage may be detected when the expression level of the PDE4D7 marker is decreased in comparison to the normal control level, in particular a healthy tissue or a non-progressive prostate tumor. In a preferred embodiment of the present invention a progressive prostate cancer may be detected if the expression level of the PDE4D7 marker is similar to an expression level of an established, e.g. independently established, progressive prostate cancer cell or cell line, e.g. a progressive prostate cancer cell line.

A non-progressive or progressive prostate cancer may be detected when the expression level of at least one of PDE4D1, PDE4D2, PDE4D3, PDE4D4, PDE4D4, PDE4D5, PDE4D6, PDE4D8 and PDE4D9 marker is decreased in comparison to the normal control level as defined herein above. In a preferred embodiment of the present invention a non-progressive or progressive prostate cancer may be detected if the expression level of at least one of PDE4D1, PDE4D2, PDE4D3, PDE4D4, PDE4D5, PDE4D6, PDE4D8 and PDE4D9 marker is similar to an expression level of an established, e.g. independently established, prostate cancer cell or cell line.

The term "monitoring prostate cancer" as used herein relates to the accompaniment of a diagnosed or detected prostate cancer disease or disorder, e.g. during a treatment procedure or during a certain period of time, typically during 2 months, 3 months, 4 months, 6 months, 1 year, 2 years, 3 years, 5 years, 10 years, or any other period of time. The term "accompaniment" means that states of disease as defined herein above and, in particular, changes of these sates of disease may be detected by comparing the expression level of the PDE4D variant marker of the present invention in a sample to a normal control level as defined herein above, preferably a control expression level derived from a progressive tumor control, a non-progressive tumor control or a healthy control or to the expression level of an established, e.g. independently established, prostate cancer cell or cell line, or a cell line in any type of periodical time segment, e.g. every week, every 2 weeks, every month, every 2, 3, 4, 5, 6, 7, 8, 9, 10, 11 or 12 month, every 1.5 year, every 2, 3, 4, 5, 6, 7, 8, 9 or 10 years, during any period of time, e.g. during 2 weeks, 3 weeks, 1, 2, 3, 4, 5, 6, 7, 8, 9, 10, 11, 12 months, 1.5, 2, 3, 4, 5, 6, 7, 8, 9, 10, 15 or 20 years, respectively. The established, e.g. independently established, prostate cancer cell or cell line giving rise to an additional control level may be derived from samples corresponding to different stages of cancer development, e.g. stages 0 and I to IV of the TNM classification system. In a preferred embodiment of the present invention the term relates to the accompaniment of a diagnosed prostate cancer, more preferably of a progressive or non-progressive prostate cancer. The monitoring may also include the detection of the expression of additional genes or genetic elements, e.g. housekeeping genes.

The term "prognosticating prostate cancer" as used herein refers to the prediction of the course or outcome of a diagnosed or detected prostate cancer, e.g. during a certain period of time, during a treatment or after a treatment. The term also refers to a determination of chance of survival or recovery from the disease, as well as to a prediction of the expected survival time of a subject. A prognosis may, specifically, involve establishing the likelihood for survival of a subject during a period of time into the future, such as 6 months, 1 year, 2 years, 3 years, 5 years, 10 years or any other period of time.

The term "transcription factor ERG" as used herein refers to a nuclear protein that binds purine-rich sequences of DNA, which is encoded by gene ERG (ETS-related gene), an oncogene. ERG is a member of the ETS (erythroblast transformation-specific) family of transcription factors. Transcriptional regulator ERG is required for platelet adhesion to the subendothelium and regulates hematopoiesis. It has a DNA binding domain and a PNT (pointed) domain.

In some embodiments, the up-regulated expression of PDE4D indicates an up-regulated expression level of transcription factor ERG or the presence of TMPRSS2-ERG gene fusion.

The term "reference gene" or "control gene" as used herein refers to any suitable gene, e.g. to any steadily expressed and continuously detectable gene, gene product, expression product, protein or protein variant in the organism of choice. The term also includes gene products such as expressed proteins, peptides, polypeptides, as well as modified variants thereof. The invention hence also includes reference proteins derived from a reference gene. Also encompassed are all kinds of transcripts derivable from the reference gene as well as modifications thereof or secondary parameters linked thereto. Alternatively or additionally, other reference parameters may also be used for reference purposes, e.g. metabolic concentrations, cell sizes etc.

The expression may preferably be carried out in the same sample, i.e. the level of a PDE4D variant and of the reference gene is determined in the same sample. If the testing is carried out in the same sample, a single detection or a multiplex detection approach as described herein may be performed. For the performance of the multiplex detection the concentration of primers and/or probe oligonucleotides may be modified. Furthermore, the concentration and presence of further ingredients like buffers, ions etc. may be modified, e.g. increased or decreased in comparison to manufacturers' indications.

In a specific embodiment of the present invention, the expression of more than one reference gene or steadily expressed gene may be determined. E.g. the expression of 2, 3, 4, 5, 6, 7, 8, 9, 10, 12, 15, 20, 30 or more reference genes may be determined. The results of such measurements may be either calculated separately, or may be combined in order to obtain an average expression index. Furthermore, pattern of reference gene expression may be determined and/or used as basis for subsequent steps. Such pattern may be based on known expression behaviors of genes in certain cancer, in particular prostate cancer stages or states.

Furthermore, expression results may be compared to already known results from reference cases or databases. The comparison may additionally include a normalization procedure in order to improve the statistical relevance of the results.

In an alternative embodiment of the present invention, instead of determining the level of expression of a reference gene in a sample, the expression of a further cancer marker or non-steadily expressed gene may be determined. For example, the expression of a gene, which is known to be reduced during hormone-resistant prostate cancer, or which is known to be increased during hormone-sensitive prostate cancer, may be determined.

In a further embodiment, also both expression determinations may be carried out, i.e. the determination of expression of a reference gene and of a further cancer or biomarker gene.

Exemplary control genes include inter alia *Homo sapiens* TATA box binding protein (TBP), *Homo sapiens* hypoxanthine phosphoribosyltransferase 1 (HPRT1), *Homo sapiens* actin, beta, mRNA (ACTB), *Homo sapiens* 60S acidic ribosomal phosphoprotein P0 mRNA (RPLP0), *Homo sapiens pumilio* RNA-Binding Family Member (PUM1), Polymerase (RNA) II (DNA Directed) Polypeptide A, 220 kDa (POLR2A), Beta-2-Microglobulin (B2M), Tubulin-Alpha-1b (K-ALPHA-1), Aminolevulinate-Delta-Synthase (ALAS-1).

In a specific embodiment in the methods as described herein the following steps are carried out (a2) determining the expression level of a reference gene in a sample; (a3) normalizing the measured expression level of the PDE4D variants of step (a) to the expression of the reference gene to obtain a normalized gene expression profile; wherein the prostate cancer progression state and/or the prostate cancer progression index are based on the normalized gene expression profile of the PDE4D variants of step (a3).

The term "wherein none of PDE4D variants is used as a reference gene" means that the PDE4D variant is not used as reference gene for normalizing the measured expression level.

In particular PDE4D5 is not used as a reference gene.

More particular, none of the PDE4D variants is used as reference gene to normalize the expression level of PDE4D7.

In an even more particular embodiment PDE4D5 is not used as reference gene to normalize the expression level of PDE4D7.

Expression results may be normalized according to any suitable method known to the person skilled in the art. Typically, such tests or corresponding formula, which would be known to the person skilled in the art, would be used to standardize expression data to enable differentiation between real variations in gene expression levels and variations due to the measurement processes. For microarrays, the Robust Multi-array Average (RMA) may be used as normalization approach.

In a specific embodiment the normalized values are generated by applying the following:

$$N(Cq_{gene\ of\ interest}) = \text{Mean}(Cq_{ref\ gene}) - (Cq_{gene\ of\ interest})$$

Where $N(Cq_{gene\ of\ interest})$ is normalized gene expression value for selected genes of interest; where $\text{Mean}(Cq_{ref\ gene})$ is the arithmetic mean of the PCR Cq values of the selected combination of reference genes; where $(Cq_{gene\ of\ interest})$ is the PCR Cq value of the gene of interest.

In a specific embodiment the normalized values are generated by applying the following:

$$N(Cq_{gene\ of\ interest}) = \text{Mean}(Cq_{ref\ gene}) - (Cq_{gene\ of\ interest})$$

Where $N(Cq_{gene\ of\ interest})$ is normalized gene expression value for selected genes of interest; where $\text{Mean}(Cq_{ref\ gene})$ is the arithmetic mean of the PCR Cq values of the of at least two reference genes selected from TBP, HPRT1, ACTB, RPLP0, POLR2A, B2M, PUM1, K-ALPHA-1 and ALAS-1; where $(Cq_{gene\ of\ interest})$ is the PCR Cq value of the gene of interest.

In a specific embodiment the normalized values are generated by applying the following:

$$N(Cq_{gene\ of\ interest}) = \text{Mean}(Cq_{ref\ gene}) - (Cq_{gene\ of\ interest})$$

Where $N(Cq_{gene\ of\ interest})$ is normalized gene expression value for selected genes of interest; where $\text{Mean}(Cq_{ref\ gene})$ is the arithmetic mean of the PCR Cq values of the of the reference genes TBP, HPRT1, ACTB and RPLP0; where $(Cq_{gene\ of\ interest})$ is the PCR Cq value of the gene of interest.

In a specific embodiment the normalized values are generated by applying the following:

$$N(Cq_{gene\ of\ interest}) = \text{Mean}(Cq_{ref\ gene}) - (Cq_{gene\ of\ interest})$$

Where $N(Cq_{gene\ of\ interest})$ is normalized gene expression value for selected genes of interest; where $\text{Mean}(Cq_{ref\ gene})$ is the arithmetic mean of the PCR Cq values of the of the reference genes TBP, HPRT1, PUM1, K-ALPHA-1 and ALAS-1 where $(Cq_{gene\ of\ interest})$ is the PCR Cq value of the gene of interest.

Exemplary reference genes include inter alia TATA box binding protein (TBP), *Homo sapiens* hypoxanthine phosphoribosyltransferase 1 (HPRT1), *Homo sapiens* actin, beta, mRNA (ACTB), *Homo sapiens* 60S acidic ribosomal phosphoprotein P0 mRNA (RPLP0), *Homo sapiens* pumilio RNA-Binding Family Member (PUM1), Polymerase (RNA) II (DNA Directed) Polypeptide A, 220 kDa (POLR2A), Beta-2-Microglobulin (B2M), Tubulin-Alpha-1b (K-ALPHA-1), Aminolevulinate-Delta-Synthase (ALAS-1). A particularly preferred combination is TBP, HPRT1, ACTB, RPLP0. Another particularly preferred combination is TBP, HPT1, PUM1, K-ALPHA-1, ALAS-1.

Another preferred embodiment the combination of reference genes comprises TBP, HPRT1 and at least one, at least two or at least three additional reference genes selected from the group comprising ACTB, RPLP0, PUM1, POLR2A, B2M, K-ALPHA-1 (TUBA1B) or ALAS-1.

Another preferred embodiment the combination of reference genes comprises TBP, HPRT1 and at least two additional reference genes selected from the group comprising ACTB, RPLP0, PUM1, K-ALPHA-1 (TUBA1B) or ALAS-1.

A particularly preferred combination is TBP, HPRT1, ACTB, RPLP0. Another particularly preferred combination is TBP, HPRT1, PUM1, K-ALPHA-1, ALAS-1. A detailed description of the reference genes including their Transcript ID (NCBI RefSeq) and the SEQ ID NO of the corresponding nucleotide sequence, the protein ID (protein accession) and the SEQ ID NO of the corresponding amino acid sequence is disclosed in FIG. 2. Further FIG. 2 discloses for each reference gene a forward primer, reverse primer for the generation of an amplicon which is specific for the reference gene and a probe sequence that specifically binds to the amplicon.

In particular, the reference gene is not a PDE4D variant.

In a specific embodiment the PDE4D variants are selected from the group comprising PDE4D1, PDE4D2, PDE4D4, PDE4D5, PDE4D7 and PDE4D9.

In another specific embodiment the PDE4D variants are selected from the group comprising PDE4D1, PDE4D2, PDE4D5, PDE4D7 and PDE4D9.

In a further embodiment the PDE4D variants are selected from the group comprising PDE4D4, PDE4D5, PDE4D7 and PDE4D9.

In another specific embodiment the PDE4D variants are selected from the group comprising PDE4D5 and PDE4D7.

In another specific embodiment the PDE4D variants are selected from the group comprising PDE4D5, PDE4D7 and PDE4D9.

In another specific embodiment the PDE4D variants are selected from the group consisting of PDE4D5 and PDE4D7.

In a preferred embodiment the expression level of at least three PDE4D variants, of at least four PDE4D variants, of at least 5 PDE4D variants is selected in step (a).

In a more preferred embodiment the expression level of at least three PDE4D variants is selected in step (a).

In a further embodiment the expression level of different PDE4D variants is determined together, for example by a probe that detects several PDE4D variants together.

In a preferred embodiment the expression level of PDE4D1 and PDE4D2 is determined for both variants together. That means that only a single probe is used to report the expression of these very closely related PDE4D variants PDE4D1 and PDE4D2 together.

In the context of the present invention, the terms "diagnosing" and "prognosticating" are also intended to encompass predictions and likelihood analyses. PDE4D variants as markers may accordingly be used clinically in making decisions concerning treatment modalities, including therapeutic intervention or diagnostic criteria such as a surveillance for the disease. According to the present invention, an intermediate result for examining the condition of a subject may be provided. Such intermediate result may be combined with additional information to assist a doctor, nurse, or other practitioner to diagnose that a subject suffers from the disease. Alternatively, the present invention may be used to detect cancerous cells in a subject-derived tissue, and provide a doctor with useful information to diagnose that the subject suffers from the disease.

A subject or individual to be diagnosed, monitored or prognosticated prostate cancer or the progression state of prostate cancer according to the present invention is an animal, preferably a mammal, more preferably a human being.

Particularly preferred is the use of molecular imaging tools as known to the person skilled in the art, e.g. magnetic resonance imaging (MRI) and/or magnetic photon resonance imaging (MPI) technology in the context of using PDE4D variants as a marker for diagnosing, monitoring or prognosticating malignant, hormone-sensitive prostate cancer of the progression towards malignant, hormone-sensitive prostate cancer. For example, PDE4D variants may be used as a marker diagnosing, monitoring or prognosticating prostate cancer or the progression state of prostate cancer in approaches like MRI or MPI that allows for online detection of the diagnostic marker within a human subject.

In some embodiments, it is provided with a method for diagnosing, monitoring or prognosticating prostate cancer or the progression state of prostate cancer, comprising the steps of (a) determining the expression level of at least two PDE4D variants selected from the group comprising of PDE4D1, PDE4D2, PDE4D3, PDE4D4, PDE4D5, PDE4D6, PDE4D7, PDE4D8 and PDE4D9 in a sample to obtain a gene expression profile;

(b) determining at least one PDE-Index indicative for the prostate cancer progression state based on the gene expression profile obtained in step (a).

In some embodiments, it is provided with a method of identifying an individual for eligibility for prostate cancer therapy comprising:

(a) determining in a sample obtained from an individual the expression level of at least two PDE4D variants selected from the group comprising of PDE4D1, PDE4D2, PDE4D3, PDE4D4, PDE4D5, PDE4D6, PDE4D7, PDE4D8 and PDE4D9 to obtain a gene expression profile;

(b) determining at least one prostate cancer progression index based on the gene expression profile of PDE4D variants indicative for the prostate cancer progression state of step (a);

(c) identifying the individual as eligible to receive a prostate cancer therapy where the PDE-Index of the individual's sample indicates the presence of prostate cancer or wherein the PDE-Index of the individual's sample indicates a non-progressive or progressive prostate cancer progression state.

The term "PDE-Index" refers to the combination of the expression values of at least two PDE4D isoforms into a single data model. The PDE-Index thereby provides significantly improved classification power to predict the prostate cancer progression state.

In a specific embodiment the prostate cancer progression state is non-progressive or progressive.

The PDE-Index may be for example:

i) PDE-Index_1:

PDE4D7_exp-PDE4D5_exp, ii) PDE-Index_2:

MEAN(PDE4D7_exp & PDE4D5_exp), iii) PDE-Index_3:

(MEAN(PDE4D5_exp & PDE4D7_exp & PDE4D9_exp))/(PDE4D4_exp), or iv) PDE-Index_4:

(MEAN(PDE4D5_exp & PDE4D7_exp & PDE4D9_exp))/(PDE4D1&PDE4D2_exp).

v) PDE-Index_5:

(MEAN(PDE4D5_exp & PDE4D7_exp&PDE4D9_exp))

The term "PDE4D4_exp" denotes the normalized (to reference genes) expression level of PDE4D4, the term "PDE4D5_exp" denotes the normalized (to reference genes) expression level of PDE4D5, the term "PDE4D7_exp" denotes the normalized (to reference genes) expression level of PDE4D7 and the term "PDE4D9_exp" denotes the normalized (to reference genes) expression level of PDE4D9. The term "PDE4D1&PDE4D2_exp" denotes the normalized (to reference genes) expression levels of PDE4D1 and PDE4D2, detected together by a single assay.

The prostate cancer progression index PDE-Index_1 is determined by PDE4D7_exp-PDE4D5_exp. PDE-Index_1 in particular distinguishes noncancerous prostate from prostate cancer. Preferably PDE-Index_1 distinguishes noncancerous prostate from cancerous prostate.

For example, a PDE-Index_1 below a predetermined cutoff value is indicative for noncancerous prostate and a PDE-Index_1 above the predetermined cutoff value is indicative for prostate cancer.

PDE-Index_2 is determined by MEAN(PDE4D7_exp & PDE4D5_exp). PDE-Index_2 discriminates between non-progressive and progressive cancer progression state.

For example, a PDE-Index_2 below a predetermined cutoff value is indicative for progressive prostate tumor state and a PDE-Index_2 above the predetermined cutoff value is indicative for non-progressive prostate cancer progression state.

In another embodiment, a PDE-Index_2 below control levels is indicative for progressive prostate tumor state and a PDE-Index_2 above control level is indicative for non-progressive prostate cancer progression state.

PDE-Index_3 is determined by (MEAN(PDE4D5_exp & PDE4D7_exp & PDE4D9_exp))/(PDE4D4_exp).

PDE-Index_3 discriminates between non-progressive and progressive cancer progression state.

For example, a PDE-Index_3 below a predetermined cutoff value is indicative for progressive prostate tumor state and a PDE-Index_3 above the predetermined cutoff value is indicative for non-progressive prostate cancer progression state.

PDE-Index_4 is determined by (MEAN(PDE4D5_exp & PDE4D7_exp & PDE4D9_exp))/(PDE4D1&PDE4D2_exp).

PDE-Index_4 discriminates between non-progressive and progressive cancer progression state.

PDE-Index_5 is determined by (MEAN(PDE4D5_exp & PDE4D7_exp & PDE4D9_exp)).

PDE-Index_5 discriminates between non-progressive and progressive cancer progression state.

For example, a PDE-Index_4 below a predetermined cutoff value is indicative for progressive prostate tumor state and a PDE-Index_4 above the predetermined cutoff value is indicative for non-progressive prostate cancer progression state.

The term "predetermined cutoff" may be defined based on a control level, i.e. a PDE-Index which is determined for non-cancerous tissue or non-progressive prostate tissue. In a specific embodiment the cut-off may be set to the control level. In another embodiment the cut-off may differ from the control level.

In an additional embodiment a PDE-Index_1 below a control level is indicative for noncancerous prostate and a PDE-Index_1 above a control level is the predetermined cutoff value is indicative for prostate cancer.

In an additional embodiment a PDE-Index_1 below a control level is indicative for noncancerous prostate and a PDE-Index_1 above a control level is the predetermined cutoff value is indicative for prostate cancer, wherein the control level is the PDE-Index_1 of noncancerous tissue.

In another embodiment, a PDE-Index_2 below a control level is indicative for progressive prostate tumor state and a PDE-Index_2 above a control level is indicative for non-progressive prostate cancer progression state.

In a preferred embodiment, a PDE-Index_2 below control levels is indicative for progressive prostate tumor state and a PDE-Index_2 above control level is indicative for non-progressive prostate cancer progression state, wherein the control level is the PDE-Index_2 of non-progressing tumor tissue.

In another embodiment, a PDE-Index_3 below a control level is indicative for progressive prostate tumor state and a PDE-Index_3 above a control level is indicative for non-progressive prostate cancer progression state.

In a preferred embodiment, a PDE-Index_3 below control levels is indicative for progressive prostate tumor state and a PDE-Index_3 above control level is indicative for non-progressive prostate cancer progression state, wherein the control level is the PDE-Index_3 of non-progressing tumor tissue.

In another embodiment, a PDE-Index_4 below a control level is indicative for progressive prostate tumor state and a PDE-Index_4 above a control level is indicative for non-progressive prostate cancer progression state.

In a preferred embodiment, a PDE-Index_4 below control levels is indicative for progressive prostate tumor state and a PDE-Index_4 above control level is indicative for non-progressive prostate cancer progression state, wherein the control level is the PDE-Index_4 of non-progressing tumor tissue.

In another embodiment, a PDE-Index_5 below a control level is indicative for progressive prostate tumor state and a PDE-Index_5 above a control level is indicative for non-progressive prostate cancer progression state.

In a preferred embodiment, a PDE-Index_5 below control levels is indicative for progressive prostate tumor state and a PDE-Index_5 above control level is indicative for non-progressive prostate cancer progression state, wherein the control level is the PDE-Index_5 of non-progressing tumor tissue.

In a specific embodiment of the invention the presence of the TMPRSS2-ERG gene is determined, i.e. it is determined whether the sample is TMPRSS2-ERG positive or negative. In particular, it is determined whether TMPRSS2-ERG as described in Tomlins, S. A. et al. "Recurrent fusion of TMPRSS2 and ETS transcription factor genes in prostate cancer." Science 310, 644-648 (2005) is expressed. TMPRSS2-ERG is a genomic rearrangement between the androgen regulated serine protease TMPRSS2 and the transcription factor ERG2 which is member of the ETS transcription family. The methods as described herein provide in particularly significantly improved classification power to predict the progression of prostate cancer in samples in which the TMPRSS2-ERG gene or expression of the TMPRSS2-ERG can be detected.

In a preferred embodiment the methods of the invention are applied to samples which TMPRSS2-ERG is present.

The level of the PDE4D variant may be determined on the nucleic acid level, protein level or activity level as described herein. Preferred is the determination of the amount of PDE4D variant transcript(s) and/or protein. In addition the level of a reference gene in sample may be determined.

In a preferred embodiment of the present invention the diagnosing, monitoring or prognosticating as mentioned above is to be carried out on a sample obtained from an individual. The term "sample obtained from an individual" as used herein relates to any biological material obtained via suitable methods known to the person skilled in the art from an individual. The sample used in the context of the present invention should preferably be collected in a clinically acceptable manner, more preferably in a way that nucleic acids (in particular RNA) or proteins are preserved.

The biological samples may include body tissues and fluids, such as blood, sweat, and urine. Furthermore, the biological sample may contain a cell extract derived from or a cell population including an epithelial cell, preferably a cancerous epithelial cell or an epithelial cell derived from tissue suspected to be cancerous. Even more preferably the biological sample may contain a cell population derived from a glandular tissue, e.g. the sample may be derived from the prostate of a male individual. Additionally, cells may be purified from obtained body tissues and fluids if necessary, and then used as the biological sample.

Samples, in particular after initial processing, may be pooled. However, also non-pooled samples may be used.

In a specific embodiment of the present invention the content of a biological sample may also be submitted to an enrichment step. For instance, a sample may be contacted with ligands specific for the cell membrane or organelles of certain cell types, e.g. prostate cells, functionalized for example with magnetic particles. The material concentrated by the magnetic particles may subsequently be used for detection and analysis steps as described herein above or below.

In a specific embodiment of the invention, biopsy or resections samples may be obtained and/or used. Such samples may comprise cells or cell lysates.

Furthermore, cells, e.g. tumor cells, may be enriched via filtration processes of fluid or liquid samples, e.g. blood, urine, etc. Such filtration processes may also be combined with enrichment steps based on ligand specific interactions as described herein above.

In a particularly preferred embodiment of the present invention a sample may be a tissue sample, a biopsy sample, a urine sample, a urine sediment sample, a blood sample, a saliva sample, a semen sample, a sample comprising circulating tumor cells, or a sample containing prostate secreted exosomes. A blood sample, may, for example, be a serum sample or a plasma sample.

In embodiments of the invention, the marker gene expression pattern (or the PDE-Index) may be correlated to pre- or post-surgery PSA levels, Gleason score and pT stage.

In a preferred embodiment of the present invention the method as described herein comprises the additional step of determining pGleason score and/or pT stage.

In a more preferred embodiment of the present invention the method as described herein comprises the additional step of determining pGleason score and pT stage.

"Gleason score" or "pGleason" refers to the grading of a sample of prostate cancer by a trained pathologist according to the Gleason system, which assigns a Gleason score using numbers from 1 to 5 based upon similarities in the cells of a sample of prostate tissue to cancerous tissue or normal prostate tissue. Tissue that looks much like normal prostate tissue is given a score or grade of 1 while a tissue that lacks normal features and the cells seem to be spread haphazardly through the prostate is given a score or grade of 5. Scores, or grades of 2 through 4, inclusive, have features in between these possibilities. But because prostate cancers may have areas with different scores or grades, separate scores or grades are given to the two areas that make up most of the tissue. The two scores or grades are added to yield a Gleason score (or Gleason sum) between 2 and 10.

In an additional aspect, the analysis of expression levels may be performed in combination with, or in place of, other assessments or indicators of prostate cancer. In some embodiments, the analysis is made in combination with a method of determining the grade of prostate cancer in a sample comprising prostate cancer cells from a subject. In other embodiments, the combination is with a method of determining the stage of prostate cancer in the sample. A third possibility is combination with detecting or determining PSA levels in the subject, optionally before a procedure used to isolate the prostate cancer cells. Of course a combination with any one, two, or all three of these representative examples is possible. Whenever more than one type of assessment is used, the result is a multivariate analysis. The invention expressly includes all possible combinations of assessments described herein as multivariate embodiments.

Generally, any accepted method of assessing prostate cancer grade and/or stage as known to the skilled person may be used. In some cases, the method of determining prostate cancer grade comprises determination of a Gleason Score (or Gleason Grade). In other cases, the method of determining prostate cancer stage comprises a determination according to the American Joint Committee on Cancer (AJCC) tumor staging system for assessing prostate cancer stage. And as described herein, the analysis of gene (sequence) expression levels may be performed in place of either the Gleason Score or the AJCC tumor stage determination. In cases of PSA levels, its assessment may be conducted before a prostatectomy which is used to provide a sample comprising prostate cancer cells for use in any method described herein.

In a further embodiment of the present invention the method as described herein above may further be combined with one or more similar identification methods, based on the expression of one or more different biomarkers. Preferred is the determination of the level of prostate specific antigen (PSA) in blood. Thus, if the level of PSA in blood is encountered to be of a ranger of about 2 to 5 or more ng/ml, preferably of about 2.2 to 4.8 ng/ml or more, 2.4 to 4.4 ng/ml or more, 2.6 to 4.2 ng/ml ore more or 2.8 to 4.0 ng/ml or more, more preferably of about 2.5 to 4 ng/ml or more, an individual may be considered to be suffering from malignant hormone-sensitive prostate cancer, or be likely to develop malignant hormone-sensitive prostate cancer in the near future, i.e. within the next 1, 2, 3, 4, 5, 6, 12, 14, 48 months. The testing for expression of PDE4D variants may be carried out according to steps as defined herein. As controls or control samples controls as defined herein above may be used. In a particularly preferred embodiment the testing steps may be based on the use of an antibody specifically binding to a specific PDE4D variant or several PDE4D variants, e.g. commercially available anti-PDE4D7 antibody like NB300-652 or GTX14629.

In one embodiment the gene expression level is determined by detecting mRNA expression using one or more probes and/or one or more probe sets.

In some embodiments, it is provided with methods for diagnosing, monitoring or prognosticating prostate cancer or the progression state of prostate cancer, e.g. in an individual, comprising at least the step of determining the level of marker gene(s) or GOI's in a sample. The terms "determining the level of marker gene(s) or GOI's" or "determining the gene expression level" or "determining the expression level of PDE4D variants" refers to the determination of the presence or amount of marker gene(s) or GOI's or PDE4D variant's expression products. The term "level of marker gene(s) or GOI's" thus means the presence or amount of marker gene(s) or GOI's expression products, e.g. transcript(s), and/or the determination of the presence or amount of marker gene(s) or GOI's. The determination of the presence or amount of marker gene(s) or GOI's expression products, may be accomplished by any means known in the art.

In a preferred embodiment of the present invention the determination of the presence or amount of marker gene(s) or GOI's expression products is accomplished by the measurement of nucleic acid. Thus, the expression level(s) may be determined by a method involving the detection of an mRNA encoded by the gene.

For example, the measurement of the nucleic acid level of marker gene(s) or GOI's expression may be assessed by purification of nucleic acid molecules (e.g. RNA or cDNA) obtained from the sample, followed by hybridization with specific oligonucleotide probes as defined herein above. Comparison of expression levels may be accomplished visually or by means of an appropriate device. Methods for the detection of mRNA or expression products are known to the person skilled in the art.

Alternatively, the nucleic acid level of marker gene(s) or GOI's expression may be detected in a DNA array or microarray approach. Typically, sample nucleic acids derived from patients to be tested are processed and labeled, preferably with a fluorescent label. Subsequently, such nucleic acid molecules may be used in a hybridization approach with immobilized capture probes corresponding to the marker genes of the present invention. Suitable means for carrying out microarray analyses are known to the person skilled in the art.

In a standard setup a DNA array or microarray comprises immobilized high-density probes to detect a number of genes. The probes on the array are complementary to one or more parts of the sequence of the marker genes. Typically, cDNAs, PCR products, and oligonucleotides are useful as probes.

A DNA array- or microarray-based detection method typically comprises the following steps: (1) Isolating mRNA from a sample and optionally converting the mRNA to cDNA, and subsequently labeling this RNA or cDNA. Methods for isolating RNA, converting it into cDNA and for labeling nucleic acids are described in manuals for micro array technology. (2) Hybridizing the nucleic acids from step 1 with probes for the marker genes. The nucleic acids from a sample can be labeled with a dye, such as the fluorescent dyes Cy3 (red) or Cy5 (blue). Generally a control sample is labeled with a different dye. (3) Detecting the hybridization of the nucleic acids from the sample with the probes and determining at least qualitatively, and more particularly quantitatively, the amounts of mRNA in the sample for marker genes investigated. The difference in the expression level between sample and control can be estimated based on a difference in the signal intensity. These can be measured and analyzed by appropriate software such as, but not limited to the software provided for example by Affymetrix.

There is no limitation on the number of probes corresponding to the marker genes used, which are spotted on a DNA array. Also, a marker gene can be represented by two or more probes, the probes hybridizing to different parts of a gene. Probes are designed for each selected marker gene. Such a probe is typically an oligonucleotide comprising 5-50 nucleotide residues. Longer DNAs can be synthesized by PCR or chemically. Methods for synthesizing such oligonucleotides and applying them on a substrate are well known in the field of micro-arrays. Genes other than the marker genes may be also spotted on the DNA array. For example, a probe for a gene whose expression level is not significantly altered may be spotted on the DNA array to normalize assay results or to compare assay results of multiple arrays or different assays.

Alternatively, the nucleic acid level of marker gene(s) or GOI's expression may be detected in a quantitative RT-PCR approach, preferably in a real-time PCR approach following the reverse transcription transcripts of interest. Typically, as first step, a transcript is reverse transcribed into a cDNA molecule according to any suitable method known to the person skilled in the art. A quantitative or real-time PCR approach may subsequently be carried out based on a first DNA strand obtained as described above.

Preferably, Taqman or Molecular Beacon probes as principal FRET-based probes of this type may be used for quantitative PCR detection. In both cases, the probes, serve as internal probes which are used in conjunction with a pair of opposing primers that flank the target region of interest, preferably a set of marker gene(s) specific oligonucleotides as defined herein above. Upon amplification of a target segment, the probe may selectively bind to the products at an identifying sequence in between the primer sites, thereby causing increases in FRET signaling relative to increases in target frequency.

Preferably, a Taqman probe to be used for a quantitative PCR approach according to the present invention may comprises a specific oligonucleotide as defined above of about 22 to 30 bases that is labeled on both ends with a FRET pair. Typically, the 5' end will have a shorter wavelength fluorophore such as fluorescein (e.g. FAM) and the 3' end is commonly labeled with a longer wavelength fluorescent quencher (e.g. TAMRA) or a non-fluorescent quencher compound (e.g. Black Hole Quencher). It is preferred that the probes to be used for quantitative PCR, in particular probes as defined herein above, have no guanine (G) at the 5' end adjacent to the reporter dye in order to avoid quenching of the reporter fluorescence after the probe is degraded.

A Molecular Beacon probe to be used for a quantitative PCR approach according to the present invention preferably uses FRET interactions to detect and quantify a PCR product, with each probe having a 5' fluorescent-labeled end and a 3' quencher-labeled end. This hairpin or stem-loop configuration of the probe structure comprises preferably a stem with two short self-binding ends and a loop with a long internal target-specific region of about 20 to 30 bases.

Alternative detection mechanisms which may also be employed in the context of the present invention are directed to a probe fabricated with only a loop structure and without a short complementary stem region. An alternative FRET-based approach for quantitative PCR which may also be used in the context of the present invention is based on the use of two hybridization probes that bind to adjacent sites on the target wherein the first probe has a fluorescent donor label at the 3' end and the second probe has a fluorescent acceptor label at its 5' end.

In a specific embodiment the gene expression level is determined by an amplification based method and/or microarray analysis and/or RNA sequencing.

In a specific embodiment, in step (c) of the method of identifying an individual for eligibility for prostate cancer therapy an individual is identified as eligible to receive a prostate cancer therapy selected from prostate surgery, prostate removal, chemotherapy, radiotherapy, limited or extended lymph node dissection, where the prostate cancer progression index of the individual's sample indicates an progressive prostate cancer progression state.

In some embodiments, it is provided with a method of identifying an individual for eligibility for prostate cancer therapy comprising:
(a) determining in a sample obtained from an individual the expression level of at least two PDE4D variants selected from the group comprising of PDE4D1, PDE4D2, PDE4D3, PDE4D4, PDE4D5, PDE4D6, PDE4D7, PDE4D8 and PDE4D9 to obtain a gene expression profile;
(b) determining at least one prostate cancer progression index based on the gene expression profile of PDE4D variants indicative for the prostate cancer progression state of step (a);
(c) identifying the individual as eligible to receive a prostate cancer therapy where the PDE-Index of the individual's sample indicates the presence of prostate cancer or wherein the PDE-Index of the individual sample indicates a non-progressive or progressive prostate cancer progression state.

In a preferred embodiment, in step (c) of the method of identifying an individual for eligibility for prostate cancer therapy, an individual is identified as eligible to receive a prostate cancer therapy selected from prostate surgery, prostate removal, chemotherapy, radiotherapy, limited or extended lymph node dissection, where the prostate cancer progression index of the individual's sample indicates a progressive prostate cancer progression state and an individual is identified as eligible to receive as prostate cancer therapy active surveillance where the prostate cancer progression index of the individual's sample indicates a non-progressive prostate cancer progression state.

A further aspect of the invention relates to a product comprising:
primers and/or probes for determining the expression level of at least two phosphodiesterase 4D (PDE4D) variants selected from the group consisting of PDE4D1, PDE4D2, PDE4D3, PDE4D4, PDE4D5, PDE4D6, PDE4D7, PDE4D8 and PDE4D9;
optionally further comprising primers and/or probes for determining the gene expression level of a reference gene, preferably a housekeeping gene, more preferably TBP, HPRT1, ACTB, RPLP0, PUM1, POLR2A, B2M, K-ALPHA-1 or ALAS-1.

In some embodiments, it is provided with a composition comprising a set of nucleic acid molecules each comprising at least one oligonucleotide probe sequence for the analysis of the gene expression of at least two PDE4D variants PDE4D1, PDE4D2, PDE4D3, PDE4D4, PDE4D5, PDE4D6, PDE4D7, PDE4D8 and PDE4D9, optionally comprising at least one oligonucleotide probe sequence for the analysis of the gene expression of reference genes selected from TBP, HPRT1, ACTB, RPLP0, PUM1, POLR2A, B2M, K-ALPHA-1 (TUBA1B) or ALAS-1.

In some embodiments, it is provided with a nucleic acid array comprising one or more oligonucleotide probes complementary and hybridizable to a coding sequence of at least two PDE4D variants PDE4D1, PDE4D2, PDE4D3, PDE4D4, PDE4D5, PDE4D6, PDE4D7, PDE4D8 and PDE4D9, optionally comprising one or more oligonucleotide probes complementary and hybridizable to at least one of the reference genes selected from TBP, HPRT1, ACTB, RPLP0, PUM1, POLR2A, B2M, K-ALPHA-1 (TUBA1B) or ALAS-1, for determining a PDE-Index as defined herein above.

A "microarray" is a linear or two-dimensional array of discrete regions, each having a defined area, formed on the surface of a generally solid support such as, but not limited to, glass, plastic, or synthetic membrane. The density of the discrete regions on a microarray is determined by the total numbers of immobilized oligonucleotides to be detected on the surface of a single solid phase support, such as at least about 50/cm2, at least about 100/cm2, at least about 500/cm2, but below about 1,000/cm2 in some embodiments. The arrays may contain less than about 500, about 1000, about 1500, about 2000, about 2500, or about 3000 immobilized oligonucleotides in total. As used herein, a DNA microarray is an array of oligonucleotides or oligonucleotides placed on a chip or other surfaces used to hybridize to amplified or cloned oligonucleotides from a sample. Because the position of each particular group of oligonucleotides in the array is known, the identities of a sample oligonucleotides can be determined based on their binding to a particular position in the microarray.

A "oligonucleotide" is a polymeric form of nucleotides, either ribonucleotides or deoxyribonucleotides. This term refers only to the primary structure of the molecule. Thus, this term includes double- and single-stranded DNA and RNA. It also includes known types of modifications including labels known in the art, methylation, "caps", substitution of one or more of the naturally occurring nucleotides with an analog, and internucleotide modifications such as uncharged linkages (e.g., phosphorothioates, phosphorodithioates, etc.), as well as unmodified forms of the oligonucleotide.

The term "amplify" is used in the broad sense to mean creating an amplification product can be made enzymatically with DNA or RNA polymerases. "Amplification," as used herein, generally refers to the process of producing multiple copies of a desired sequence, particularly those of a sample. "Multiple copies" mean at least 2 copies. A "copy" does not necessarily mean perfect sequence complementarity or identity to the template sequence. It is possible to further use any sequencing method known in the art to identify the sequences of GOI's.

The term "corresponding" may refer to, where appropriate, a nucleic acid molecule as sharing a substantial amount of sequence identity with another nucleic acid molecule. Substantial amount means at least 95%, usually at least 98% and more usually at least 99%, and sequence identity is determined using the BLAST algorithm, as described in Altschul et al. (1990), J. Mol. Biol. 215:403-410 (using the published default setting, i.e. parameters w=4, t=17). Methods for amplifying mRNA are generally known in the art, and include reverse transcription PCR (RT-PCR) and those described in U.S. patent application Ser. No. 10/062,857 (filed on Oct. 25, 2001), as well as U.S. Provisional Patent Applications 60/298,847 (filed Jun. 15, 2001) and 60/257,801 (filed Dec. 22, 2000), all of which are hereby incorporated by reference in their entireties as if fully set forth. Another method which may be used is quantitative PCR (or Q-PCR). Alternatively, RNA may be directly labeled as the corresponding cDNA by methods known in the art.

Because the invention relies upon the identification of genes (or expressed sequences) that are over- or under-expressed, one embodiment of the invention involves determining expression by hybridization of mRNA, or an amplified or cloned version thereof (such as DNA or cDNA), of a sample cell to a oligonucleotide that is unique to a particular gene sequence. Oligonucleotides of this type may contain at least about 20, at least about 22, at least about 24, at least about 26, at least about 28, at least about 30, or at least about 32 consecutive basepairs of a gene sequence that is not found in other gene sequences. The term "about" as used in the previous sentence refers to an increase or decrease of 1 from the stated numerical value. Other embodiments may use oligonucleotides of at least or about 50, at least or about 100, at least about or 150, at least or about 200, at least or about 250, at least or about 300, at least or about 350, or at least or about 400 basepairs of a gene sequence that is not found in other gene sequences. The term "about" as used in the preceding sentence refers to an increase or decrease of 10% from the stated numerical value. Such oligonucleotides may also be referred to as oligonucleotide probes that are capable of hybridizing to sequences of the genes, or unique portions thereof, described herein. In many cases, the hybridization conditions are stringent conditions of about 30% v/v to about 50% formamide and from about 0.01M to about 0.15M salt for hybridization and from about 0.01M to about 0.15M salt for wash conditions at about 55 to about 65° C. or higher, or conditions equivalent thereto.

In other embodiments, oligonucleotide probes for use in the invention may have about or 95%, about or 96%, about or 97%, about or 98%, or about or 99% identity with the marker gene sequences the expression of which shall be determined. Identity is determined using the BLAST algorithm, as described above. These probes may also be described on the basis of the ability to hybridize to expressed marker genes used in methods of the invention under stringent conditions as described above or conditions equivalent thereto.

In many cases, the sequences are those of mRNA encoded by the marker genes, the corresponding cDNA to such mRNAs, and/or amplified versions of such sequences. In some embodiments of the invention, the oligonucleotide probes are immobilized on an array, other devices, or in individual spots that localize the probes.

Suitable labels that can be used according to the invention, include radioisotopes, nucleotide chromophores, enzymes, substrates, fluorescent molecules, chemiluminescent moieties, magnetic particles, bioluminescent moieties, and the like. As such, a label is any composition detectable by spectroscopic, photochemical, biochemical, immunochemical, electrical, optical or chemical means. The term "support" refers to conventional supports such as beads, particles, dipsticks, fibers, filters, membranes and silane or silicate supports such as glass slides.

In some embodiments, it is provided with a kit for diagnosing, monitoring or prognosticating prostate cancer or the progression state of prostate cancer for identifying an individual for eligibility for prostate cancer therapy comprising: a) an array comprising one or more oligonucleotide probes complementary and hybridizable to a coding sequence of at least two PDE4D variants PDE4D1, PDE4D2, PDE4D3, PDE4D4, PDE4D5, PDE4D6, PDE4D7, PDE4D8 and PDE4D9, optionally comprising one or more oligonucleotide probes complementary and hybridizable to at least one of the reference genes selected from TBP, HPRT1, ACTB, RPLP0, PUM1, POLR2A, B2M, K-ALPHA-1 (TUBA1B) or ALAS-1, for determining a PDE-Index as defined in any of the preceding items, b) a kit control; and c) optionally instructions for use.

Typically, the diagnostic kit of the present invention contains one or more agents allowing the specific detection of marker gene(s) or GOI's as defined herein above. The agents or ingredients of a diagnostic kit may, according to the present invention, be comprised in one or more containers or separate entities. The nature of the agents is determined by the method of detection for which the kit is intended.

Furthermore, the kit may comprise an amount of a known nucleic acid molecule, which can be used for a calibration of the kit or as an internal control. Typically, a diagnostic kit for the detection of marker gene(s) or GOI's expression products may comprise accessory ingredients like a PCR buffers, dNTPs, a polymerase, ions like bivalent cations or monovalent cations, hybridization solutions etc. Such ingredients are known to the person skilled in the art and may vary depending on the detection method carried out. Additionally, the kit may comprise an instruction leaflet and/or may provide information as to the relevance of the obtained results.

An additional aspect of the invention relates to a device for performing a method as described herein, comprising: a) a database including records comprising reference gene expression values associated with prostate cancer progression states, each reference profile comprising the expression levels of at least two PDE4D variants selected from the group consisting of PDE4D1, PDE4D2, PDE4D3, PDE4D4, PDE4D5, PDE4D6, PDE4D7, PDE4D8 and PDE4D9, and/or b) a user interface capable of receiving and/or inputting a selection of gene expression values of a set of genes, the set comprising the expression levels of at least two PDE4D variants selected from the group consisting of PDE4D1, PDE4D2, PDE4D3, PDE4D4, PDE4D5, PDE4D6, PDE4D7, PDE4D8 and PDE4D9, for use in comparing to the gene reference expression profiles in the database; c) an output that displays a prediction of the cancer status according to the expression levels of the set of genes.

A further aspect relates to a computer implemented method for diagnosing, monitoring or prognosticating prostate cancer or the progression state of prostate cancer, comprising the method steps as described herein.

In the context of the present application, the expression "computer implemented method for diagnosing, monitoring or prognosticating prostate cancer or the progression state of prostate cancer," refers to a method wherein software algorithms calculate a PDE-Index and based thereon provide a prognosis for the patient that is analyzed, wherein this method uses raw data obtained upon measurement of the gene expression level of the genes referred to herein and conversion thereof into a PDE-Index using the above-described equation.

An additional aspect of the invention relates to stimulatory pharmaceutical composition for use in the treatment or prevention of prostate cancer comprising at least one element selected from the group of:
  (a) a compound directly stimulating or modulating the activity of a PDE4D variant selected from the group consisting of PDE4D1, PDE4D2, PDE4D3, PDE4D4, PDE4D5, PDE4D6, PDE4D8, PDE4D9, preferably an allosteric agonist of the enzymatic activity;
  (b) a compound indirectly stimulating or modulating the activity of the PDE4D variant of (a);
  (c) the protein of the PDE4D variant of (a) or a biologically active equivalent thereof;
  (d) a nucleic acid encoding and expressing the PDE4D variant of (a);
  (e) a miRNA inhibitor specific for miRNAs of the PDE4D variant of (a);
  (f) a demethylation agent; and
  (g) a phosphodiesterase displacement factor, preferably a peptide, a peptidomimetic, a small molecule, an antibody or an aptamer.

In some embodiments, it is provided with a stimulatory pharmaceutical composition for use in the treatment or prevention of prostate cancer comprising at least one element selected from the group of:
  (a) a compound directly stimulating or modulating the activity of a PDE4D variant selected from the group consisting of PDE4D5, PDE4D8 and PDE4D9, preferably an allosteric agonist of the enzymatic activity;
  (b) a compound indirectly stimulating or modulating the activity of the PDE4D variant of (a);
  (c) the protein of the PDE4D variant of (a) or a biologically active equivalent thereof;
  (d) a nucleic acid encoding and expressing the PDE4D variant of (a);
  (e) a miRNA inhibitor specific for miRNAs of the PDE4D variant of (a);
  (f) a demethylation agent; and
  (g) a phosphodiesterase displacement factor, preferably a peptide, a peptidomimetic, a small molecule, an antibody or an aptamer.

An additional aspect of the invention relates to an inhibitory pharmaceutical composition for use in the treatment or prevention of prostate cancer comprising at least one element selected from the group of:
  a) a compound directly inhibiting the activity of a PDE4D variant selected from the group consisting of PDE4D1, PDE4D2, PDE4D3, PDE4D4, PDE4D5, PDE4D6, PDE4D8, PDE4D9,
  b) a compound indirectly inhibiting the activity of the PDE4D variant of (a);
  c) a dominant negative form of the protein of the PDE4D variant of (a) or a biologically active equivalent thereof;
  d) a nucleic acid encoding and expressing a dominant negative form of the PDE4D variant of (a);
  e) a miRNA specific for the PDE4D variant of (a);
  f) an antisense molecule for the PDE4D variant of (a);
  g) a siRNA specific for the PDE4D variant of (a);
  h) an aptamer specific for the expression product of the PDE4D variant of (a) or for the protein of the PDE4D variant of (a);
  i) a small molecule or peptidomimetic capable of specifically binding to the protein of the PDE4D variant of (a); and
  j) an antibody specific for the protein of the PDE4D variant of (a) and/or an antibody variant specific for the protein of the PDE4D variant of (a).
wherein the PDE4D variant is preferably selected from the group consisting of PDE4D5, PDE4D8, PDE4D9.

In some embodiments, it is provided with a stimulatory or inhibitory pharmaceutical composition for the treatment of prostate cancer, wherein the composition is administered to an individual in dependence of the PDE-Index indicative for the prostate cancer progression state.

In some embodiments, it is provided with a stimulatory or inhibitory pharmaceutical composition for the treatment of prostate cancer, wherein the composition is administered to an individual where the PDE-Index of the individual's sample indicates a progressive prostate cancer progression state.

In a preferred embodiment, the at least one of PDE-Index_2, the PDE-Index_3, the PDE-Index_4 or the PDE-Index_5 of the individual's sample is below a predetermined cutoff.

In another preferred embodiment, the at least one of PDE-Index_2, the PDE-Index_3, the PDE-Index_4 or the PDE-Index_5 of the individual's sample is below control level.

In another preferred embodiment, the at least one of PDE-Index_2, the PDE-Index_3, the PDE-Index_4 or the PDE-Index_5 of the individual's sample is below control level, wherein the control level is the PDE-Index_2, the PDE-Index_3, the PDE-Index_4 or the PDE-Index_5 respectively of the individual's sample.

A further aspect of the invention relates to a method for treating a subject having prostate cancer, the method comprising
  (i) selecting a subject having prostate cancer where the PDE-Index of the individual's sample indicates a progressive prostate cancer progression state, and
  (ii) administering the stimulatory or inhibitory pharmaceutical composition as described herein.

A further aspect of the invention relates to a method for treating a subject having prostate cancer, the method comprising
  (i) selecting a subject having prostate cancer where the PDE-Index of the individual's sample indicates a progressive prostate cancer progression state, and
  (ii) administering the stimulatory or inhibitory pharmaceutical composition as described herein.

A method for treating a subject having prostate cancer, the method comprising
  (i) selecting a subject having prostate cancer, where a least one of PDE-Index_2, the PDE-Index_3, the PDE-Index_4 or the PDE-Index_5 of the individual's sample is below a predetermined threshold, and
  (ii) administering the stimulatory or inhibitory pharmaceutical composition as described herein.

A method for treating a subject having prostate cancer, the method comprising
  (i) selecting a subject having prostate cancer, where a least one of PDE-Index_2, the PDE-Index_3, the PDE-Index_4 or the PDE-Index_5 of the individual's sample is below a predetermined threshold, and
  (ii) administering the stimulatory or inhibitory pharmaceutical composition as described herein.

The term "a compound directly stimulating or modulating the activity of a PDE4D variant" as used herein refers to a compound which is capable of increasing the activity of a PDE4D variant to degrade cAMP by a direct interaction with the PDE4D variant. Such a compound may be any direct interactor of the PDE4D variant, which has positive influence on the catalytic activity of the PDE4D variant. Such a compound may preferably be an allosteric agonist of the catalytic activity of the PDE4D variant, e.g. a homotropic allosteric modulator. Preferred allosteric agonists of the PDE4D variant are cAMP or cAMP analogs. Other directly stimulating compounds envisaged by the present invention are ions, preferably biologically active mono- and bivalent cations like $Ca^{2+}$, $Mg^{2+}$.

The term "a compound directly stimulating or modulating the activity of PDE4D" as used herein refers to a compound which is capable of increasing the activity of PDE4D without being selective to a specific variant to degrade cAMP by a direct interaction with PDE4D. Such a compound may be any direct interactor of PDE4D, which has positive influence on the catalytic activity of PDE4D. Such a compound may preferably be an allosteric agonist of the catalytic activity of PDE4D, e.g. a homotropic allosteric modulator. Preferred allosteric agonists of PDE4D are cAMP or cAMP analogs. Other directly stimulating compounds envisaged by the present invention are ions, preferably biologically active mono- and bivalent cations like $Ca^{2+}$, $Mg^{2+}$.

The term "a compound indirectly stimulating or modulating the activity of PDE4D" as used herein refers to a compound which is capable of increasing the activity of PDE4D without being selective to a specific variant to degrade cAMP by an interaction with a direct interactor of PDE4D ("indirect interactor") or via an indirect working pathway not involving an interaction with PDE4D. Such a compound may be any direct interactor of an interactor of PDE4D. The effect conveyed by the direct interactor of an interactor of PDE4D may be either positive if the interactor of PDE4D itself has a positive effect on the activity of PDE4D, or negative, if the interactor of PDE4D has a negative effect on the activity of PDE4D. Typically positively working indirect interactors may stimulate the agonistic effect of direct interactors, e.g. provoke the increase of concentration of allosterically working compounds like cAMP or analogs thereof by inhibiting cAMP degrading processes not conferred by PDE4D7, by raising the cAMP production etc.

Alternatively, such positively working indirect integrators may provoke a modification of the binding behavior of directly binding proteins, leading to an increased PDE4D activity without being selective to a specific variant. Typically negatively working indirect interactors may have an inhibitory effect on inhibitors of PDE4D. Examples of such interactors are enzymatic activities degrading PDE4D inhibitors, or proteins capable of binding and quenching PDE4D inhibitors. Alternatively, such interactors may inhibit activities leading to a degradation of PDE4D, e.g. proteinase inhibitors. Further examples and their implementation would be known to the person skilled in the art.

The term "a compound indirectly stimulating or modulating the activity of a PDE4D variant" as used herein refers to a compound which is capable of increasing the activity of a PDE4D variant to degrade cAMP by an interaction with a direct interactor of PDE4D7 ("indirect interactor") or via an indirect working pathway not involving an interaction with the PDE4D variant. Such a compound may be any direct interactor of an interactor of the PDE4D variant. The effect conveyed by the direct interactor of an interactor of the PDE4D variant may be either positive if the interactor of the PDE4D variant itself has a positive effect on the activity of the PDE4D variant, or negative, if the interactor of the PDE4D variant has a negative effect on the activity of the PDE4D variant. Typically positively working indirect interactors may stimulate the agonistic effect of direct interactors, e.g. provoke the increase of concentration of allosterically working compounds like cAMP or analogs thereof by inhibiting cAMP degrading processes not conferred by PDE4D7, by raising the cAMP production etc.

Alternatively, such positively working indirect integrators may provoke a modification of the binding behavior of directly binding proteins, leading to an increased PDE4D variant activity. Typically negatively working indirect interactors may have an inhibitory effect on inhibitors of the PDE4D variant. Examples of such interactors are enzymatic activities degrading PDE4D variant inhibitors, or proteins capable of binding and quenching PDE4D variant inhibitors. Alternatively, such interactors may inhibit activities leading to a degradation of the PDE4D variant, e.g. proteinase inhibitors. Further examples and their implementation would be known to the person skilled in the art.

Alternatively, an indirect stimulation of the PDE4D activity may be conveyed by compounds activating, protecting or sustaining the expression of the endogenous PDE4D gene. Examples of such compounds are PDE4D specific transcription factors, PDE4D specific or PDE4D variant specific mRNA stabilizing activities or PDE4D splice factors/ PDE4D specific splice factors. Further examples and their implementation would be known to the person skilled in the art.

The "PDE4D variant protein" comprised in the stimulatory pharmaceutical composition may be a PDE4D variant protein as defined herein above. In particular, it may be a protein being encoded by splice variant 1, 2, 4, 5, 6, 8, 9 of the human phosphodiesterase PDE4D as defined herein. The "PDE4D variant protein" as used in this context also comprises amino acid sequences being at least 60%, 70%, 75%, 80%, 85%, 90%, 91%, 92%, 93%, 94%, 95%, 96%, 97%, 98% or 99% identical to the sequence as set forth in SEQ ID NO: 2, 4, 6, 8, 10, 12, 16 or 18 and amino acid sequences being encoded by nucleotide sequences being at least 60%, 70%, 75%, 80%, 85%, 90%, 91%, 92%, 93%, 94%, 95%, 96%, 97%, 98% or 99% identical to the sequence as set forth in SEQ ID NO: 1, 3, 5, 9, 7, 9, 11, 15 or 17.

The "PDE4D protein" comprised in the stimulatory pharmaceutical composition may be a PDE4D variant protein as defined herein above, a mixture of several PDE4D variants or a truncated version of the PDE4D variant that is common to at least two PFE4D variants.

The term "biologically active equivalent of PDE4D" or as used herein refers to a PDE4D protein which is capable of performing all or a majority of PDE4D functions that are common to several PDE4D variants. Preferably, it relates to proteins being capable of degrading cAMP.

The term "biologically active equivalent of the PDE4D variant" or as used herein refers to a PDE4D variant protein which is capable of performing all or a majority of the PDE4D variant functions. Preferably, it relates to proteins being capable of degrading cAMP.

PDE4D, PDE4D variants or biologically active equivalents of PDE4D or PDE4D variants according to the present invention may be produced recombinantly by any suitable method known to the person skilled in the art. The present invention, thus, also encompasses methods for the production of PDE4D, PDE4D variants or biologically active equivalents of PDE4D or PDE4D variants.

Accordingly, the present invention contemplates vectors containing the oligonucleotides encoding PDE4D, PDE4D variants or biologically active equivalents of PDE4D or PDE4D variants as defined herein above, host cells, and the production of PDE4D or biologically active equivalents of PDE4D by recombinant techniques.

A suitable vector may be, for example, a phage, plasmid, viral, or retroviral vector. Retroviral vectors may be replication competent or replication defective. In the latter case, viral propagation generally will occur only in complementing host cells. Polynucleotides encoding PDE4D, PDE4D variants or biologically active equivalents of PDE4D or PDE4D variants may be joined to a vector or carrier containing a selectable marker for propagation in a host. A corresponding polynucleotide insert may be operatively linked to an appropriate promoter, such as the phage lambda PL promoter, the *E. coli* lac, trp, phoA and tac promoters, the SV40 early and late promoters and promoters of retroviral LTRs, or the PSA promoter. Other suitable promoters are known to the person skilled in the art. The expression constructs may further contain sites for transcription initiation, termination, and, in the transcribed region, a ribosome binding site for translation. The coding portion of the transcripts expressed by the constructs will preferably include a translation initiating codon at the beginning and a termination codon (UAA, UGA or UAG) appropriately positioned at the end of the polypeptide to be translated.

The polypeptides or proteins may be glycosylated or may be non-glycosylated or may otherwise by modified. In addition, polypeptides or proteins may also include an initial modified methionine residue, in some cases as a result of host-mediated processes. Furthermore, the polypeptide, protein or peptide may be modified by acetylation, pegylation, hesylation, formylation, phosphorylation, amidation, derivatization by known protecting/blocking groups, specific chemical cleavage, proteolytic cleavage, a linkage to a cellular ligand or other protein or hapylation, i.e. a fusion with a glycine-rich homo-amino-acid polymer (HAP), etc. Such modifications may be carried out by suitable techniques known to the person skilled in the art. Additionally, the polypeptide, peptide or variant may contain one or more non-classical amino acids.

In addition, PDE4D, PDE4D variants or biologically active equivalents of PDE4D or PDE4D variants of the invention can be chemically synthesized using techniques known in the art, e.g. by using a peptide synthesizer.

A "polynucleotide" is a polymeric form of nucleotides, either ribonucleotides or deoxyribonucleotides. This term refers only to the primary structure of the molecule. Thus, this term includes double- and single-stranded DNA and RNA. It also includes known types of modifications including labels known in the art, methylation, "caps", substitution of one or more of the naturally occurring nucleotides with an analog, and internucleotide modifications such as uncharged linkages (e.g., phosphorothioates, phosphorodithioates, etc.), as well as unmodified forms of the oligonucleotide.

The "nucleic acid encoding and expressing PDE4D" comprised in the stimulatory pharmaceutical composition as defined herein above refers to any suitable carrier element, e.g. as described herein above, comprising an expressable PDE4D gene.

The "nucleic acid encoding and expressing a PDE4D variant" comprised in the stimulatory pharmaceutical composition as defined herein above refers to any suitable carrier element, e.g. as described herein above, comprising an expressable PDE4D gene. Preferably, such a carrier element may comprise the nucleotide sequence as set forth in SEQ ID NO: 1, 3, 5, 7, 9, 11, 15 and 17. Such a carrier element may also comprises nucleotide sequences showing a high degree of homology to the PDE4D variant, e.g. nucleic acid sequences being at least 60%, 70%, 75%, 80%, 85%, 90%, 91%, 92%, 93%, 94%, 95%, 96%, 97%, 98% or 99% identical to the sequence as set forth in SEQ ID NO: 1, 3, 5, 7, 9, 11, 15 and 17 or nucleic acid sequences encoding amino acid sequences being at least 60%, 70%, 75%, 80%, 85%, 90%, 91%, 92%, 93%, 94%, 95%, 96%, 97%, 98% or 99% identical to the sequence as set forth in SEQ ID NO: 2, 4, 6, 8, 10, 12, 16 and 18. Alternatively, the carrier may comprise the genomic sequence of PDE4D, preferably the sequence as defined in ENSEMBL database entry ENSG00000113448 (Version ENSG00000113448.8, Ensembl release 53—March 2009), which corresponds to SEQ ID NO: 19, or derivable from Genbank Accession No. AC008934 (Version AC008934.5, GI:17386235 as of 24 Mar. 2009) in combination with Genbank Accession No. AC034234 (Version AC034234.4, GI:18390182 as of 24 Mar. 2009) or as derivable from Wang et al., 2003, Cell Signal., 15(9): 883-91. More preferably, the carrier may comprise the genomic sequence of PDE4D as defined in SEQ ID NO: 19.

Furthermore, biologically active equivalents of PDE4D or PDE4D variants as defined herein above may be comprised in a carrier of the present invention.

The polynucleotide encoding PDE4D or PDE4D variants may preferably be joined to a vector containing a selectable marker for propagation in a human cell. In a preferred embodiment the polynucleotide insert may be operatively linked to a PSA promoter.

In one embodiment of the present invention nucleic acids encoding and expressing PDE4D or PDE4D variants as defined herein above may be provided via living therapeutics. The term "living therapeutic" means that PDE4D or a PDE4D variant or biologically active equivalents of PDE4D or a PDE4D variant as defined herein above are expressed in any suitable live carrier. Accordingly, the present invention relates to corresponding polynucleotides which are suitable for expression in a living cell. The present invention also relates to vectors containing such polynucleotides, appropriate host cells, and the production of polypeptides by recombinant techniques in said host cells.

The term "live carrier" relates to any appropriate living host cell or virus known to the person skilled in the art. Representative examples of appropriate hosts include, but are not limited to, bacterial cells such as *Escherichia coli* or *Lactobacillus*, fungal cells, such as yeast cells, protozoa, insect cells, or animal cells. Preferably, the term relates to attenuated bacteria, attenuated fungal cells or attenuated protozoa. Representative examples of appropriate viruses include viruses of the group of adenoviruses, retroviruses or lentiviruses, preferably attenuated viruses of the group of adenoviruses, retroviruses or lentiviruses. In a preferred embodiment, probiotic bacterial cells, in particular probiotic *Escherichia coli* or *Lactobacillus* cells may be used. More preferably, cells of *Escherichia coli* Nissle 1973 and even more preferably cells of *Lactobacillus casei* or *Lactobacillus zeae* 393 may be used.

The "miRNA inhibitor specific for miRNAs of PDE4D" comprised in the stimulatory pharmaceutical composition as defined herein above refers to a nucleic acid molecule encoding a nucleic acid sequence complementary to a PDE4D miRNA or microRNA molecule without selectivity to a specific PDE4D variant.

The "miRNA inhibitor specific for miRNAs of the PDE4D variant" comprised in the stimulatory pharmaceutical composition as defined herein above refers to a nucleic acid molecule encoding a nucleic acid sequence complementary to a PDE4D variant miRNA or microRNA molecule.

The term "complementary" as used herein refers to a perfect complementary between the miRNA inhibitor nucleic acid (sense molecule) and the miRNA (antisense molecule) without any mismatch, as well as situations in which the nucleic acid contains any base mismatches and/or additional or missing nucleotides in comparison to the miRNA molecule. In other embodiments, the two molecules comprise one or more base mismatches or differ in their total numbers of nucleotides (due to additions or deletions). In further embodiments, the "complementary" miRNA inhibitor nucleic acid molecule comprises at least ten contiguous nucleotides showing perfect complementarity with a sequence comprised in the miRNA molecule.

Typically miRNA inhibitor nucleic acid molecules are naturally occurring DNA- or RNA molecules or synthetic nucleic acid molecules comprising in their sequence one or more modified nucleotides which may be of the same type or of one or more different types.

It is, for example, envisaged by the present invention that such a miRNA inhibitor nucleic acid molecule comprises at least one ribonucleotide backbone unit and at least one deoxyribonucleotide backbone unit. Furthermore, the miRNA inhibitor nucleic acid molecule may contain one or more modifications of the RNA backbone into 2'-O-methyl group or 2'-O-methoxyethyl group (also referred to as "2'-O-methylation"), which prevented nuclease degradation in the culture media and, importantly, also prevented endonucleolytic cleavage by the RNA-induced silencing complex nuclease, leading to irreversible inhibition of the miRNA. Another possible modification, which is functionally equivalent to 2'-O-methylation, involves locked nucleic acids (LNAs) representing nucleic acid analogs containing one or more LNA nucleotide monomers, as defined herein above.

Another class of silencers of miRNA expression to be used in the context of the present invention comprises chemically engineered oligonucleotides named "antagomirs", which represent single-stranded RNA molecules conjugated to cholesterol. The molecules may comprise between 19 and 25 nucleotides. Preferably, the molecule comprises 20, 21, 22, 23 or 24 nucleotides. More preferably, the molecule comprises 23 nucleotides (further details may be derived from Krutzfeldt et al., 2005, Nature, 438: 685-689).

In another embodiment of the present invention miRNA inhibitors as defined herein above may be provided in the form of expression vectors to be introduced into tissue or cells. Alternatively, such vectors may also be introduced in living therapeutics as defined herein above.

Typically, RNAs may be produced from transgenes provided in the form of tranfection or transient expression vectors or carriers. For instance, competitive miRNA inhibitors may be provided as transcripts expressed from strong promoters, containing more than one, preferably multiple, tandem binding sites to a microRNA of interest. A "microRNA sponge" as described in Ebert et al., 2007, Nat. Methods, 4: 721-726 is an illustrative, non-limiting example of this technique.

The "demethylation agent" comprised in the stimulatory pharmaceutical composition as defined herein above refers to an agent capable of demethylating chromatine structures, preferably promoter regions, more preferably the PDE4D or PDE4D variant promotor. Examples of demethylation agents to be used in the context of the present invention are 5-aza-2'-deoxycytidine and 5-azacytidine, which reactivate genes inappropriately silenced by structural chromatin changes that involve DNA methylation and which can reverse these changes and, therefore, restore principal cellular pathways. This typically results in gene re-expression and reversion of some aspects of the transformed state. 5-azacytidine and 5-aza-2'-deoxycytidine typically inactivate DNA cytosine C5-methyltransferases through the formation of stable complexes between the 5-aza-2'-deoxycytidine residues in DNA and the enzyme, thereby mimicking a stable transition state intermediate when bound to the methyltransferase enzyme.

A further agent, which may be comprised in a stimulatory pharmaceutical composition according to the present invention, either per se or in combination with 5-aza-2'-deoxycytidine and/or 5-azacytidine, is trichostatin A (TSA).

The "phosphodiesterase displacement factor" comprised in the stimulatory pharmaceutical composition as defined herein above refers to a compound which is capable of disturbing or disrupting the interaction of phosphodiesterases, in particular PDE4D with or without selectivity to a specific PDE4D variant, with interacting partner or interactors. Such a process may ultimately lead to an association of PDEs, in particular PDE4D with or without selectivity to a specific PDE4D variant, with different interaction partners than before and, in consequence, to a redistribution of PDEs. Such new interaction partners may sequester PDE, in particular PDE4D with or without selectivity to a specific PDE4D variant, and correspondingly modify cellular behaviors, e.g. provoke influences on receptor binding or other downstream activities. Examples of protein partners which may be involved in such a displacement reaction and/or are capable of sequestering PDE, in particular PDE4D7 are anchoring proteins like AKAPs, scaffold proteins like DISC1, beta-arrestin or RACK1, regulatory proteins like XAP2/AIP/ARA9, cAMP binding proteins like PKA-R subunits or EPACs or receptors like the beta1-adrenoceptor, as well as enzymes like ERK.

Preferred phosphodiesterase displacement factors are peptides, peptidomimetics, small molecules, antibodies and aptamters.

A "peptide" in the context of a phosphodiesterase displacement factor refers to a stretch of amino acids present in or representing phosphodiesterase molecule, either common to several PDE4D variants or specific for a certain PDE4D variant, or an interacting or sequestering protein as defined herein above. The stretch of amino acids comprised in the peptide may have a length of 5 to 100 amino acids, preferably of 10 to 50 amino acids, more preferably of 20 to 30 amino acids. The stretches may be entirely identical to the PDE or interactor protein or a portion thereof or may comprise sequence variations. For example, the peptide sequence may comprise modified amino acid residues at up to 25% of all positions, preferably modifications which do not change the structural properties or the binding properties of the molecule. The amino acid sequence present in the peptide may alternatively represent spatial domains of the PDE or interactor protein and correspondingly comprise a juxtaposition of amino acid stretches which are not adjoined in the primary sequence of the molecules.

A "peptidomimetic" in the context of a phosphodiesterase displacement factor refers is a small protein-like chain designed to mimic a peptide. Such a peptidomimetic may arise from a modification of an existing peptide, e.g. a peptide as defined herein above, in order to alter the molecule's properties. A peptidomimetic may arise from a modification which changes the molecule's stability or binding capability. These modifications typically involve changes to the peptide that will not occur naturally. For example, a peptidomimetic according to the present invention may have altered peptide backbones or may comprise non-natural amino acids. Preferably, a peptidomimetic according to the present invention may represent a phosphodiesterase molecule, either common to several PDE4D variants or specific for a certain PDE4D variant, or an interacting or sequestering protein as defined herein above.

In one embodiment of the present invention a peptidomimetic may block the interaction between PDE, either of several PDE4D variants or selectively of a specific PDE4D variant, and its interactor. In another embodiment of the present invention a peptidomimetic may enhance the interaction between PDE, either of several PDE4D variants or selectively of a specific PDE4D variant, and its interactor.

Methods and techniques for the preparation of peptidomimetics as well as assays for the testing of peptidomimetics are known to the person skilled in the art.

A "small molecules" in the context of a phosphodiesterase displacement factor refers to a small organic compound that is preferably biologically active, i.e. a biomolecule, but is preferably not a polymer. Such an organic compound may have any suitable form or chemical property. The compound may be a natural compound, e.g. a secondary metabolites or an artificial compound, which has been designed and generated de novo. In one embodiment of the present invention a small molecule is capable of blocking the interaction between PDE, either of several PDE4D variants or selectively of a specific PDE4D variant, and its interactor. In another embodiment of the present invention a small molecule may enhance the interaction between PDE, in particular PDE4D7, and its interactor. Methods and techniques for the identification and preparation of small molecules as well as assays for the testing of small molecules are known to the person skilled in the art.

An "antibody" or an "aptamer" in the context of a phosphodiesterase displacement factor refers to a PDE4D specific antibody, either specific to several PDE4D variants or selectively to a specific PDE4D variant, or antibody variant or fragment as defined herein above, or to a PDE4D7 specific aptamer, either specific to several PDE4D variants or selectively to a specific PDE4D variant, as defined herein above, having the capability of disturbing or disrupting the interaction between PDE, either of several PDE4D variants or selectively of a specific PDE4D variant, and one or more of its interactors. Alternatively, the terms may also refer to antibodies or aptamers binding to any one or more of the PDE4D/PDE4D variant interactors as described herein above, having likewise the capability of disturbing or disrupting the interaction between PDE, either of several PDE4D variants or selectively of a specific PDE4D variant, and one or more of its interactors. Methods for the production or testing of antibodies or aptamers have been described herein above and/or are known to the person skilled in the art.

A further aspect of the invention relates to a computer program product, comprising computer readable code stored on a computer readable medium or downloadable from a communications network, which, when run on a computer, implement one or more steps or all the steps of any one of the methods as described herein.

Any combination of one or more computer readable medium(s) may be utilized. The computer readable medium may be a computer readable signal medium or a computer readable storage medium. A computer readable storage medium may be, for example, but not limited to, an electronic, magnetic, optical, electromagnetic, infrared, or semiconductor system, apparatus, or device, or any suitable combination of the foregoing. More specific examples (a non-exhaustive list) of the computer readable storage medium would include the following: an electrical connection having one or more wires, a portable computer diskette, a hard disk, a random access memory (RAM), a read-only memory (ROM), an erasable programmable read-only memory (EPROM or Flash memory), an optical fiber, a portable compact disc read-only memory (CD-ROM), an optical storage device, a magnetic storage device, or any suitable combination of the foregoing. In the context of this document, a computer readable storage medium may be any tangible medium that can contain, or store a program for use by or in connection with an instruction execution system, apparatus, or device.

A computer readable signal medium may include a propagated data signal with computer readable program code embodied therein, for example, in baseband or as part of a carrier wave. Such a propagated signal may take any of a variety of forms, including, but not limited to, electromagnetic, optical, or any suitable combination thereof. A computer readable signal medium may be any computer readable medium that is not a computer readable storage medium and that can communicate, propagate, or transport a program for use by or in connection with an instruction execution system, apparatus, or device.

Program code embodied on a computer readable medium may be transmitted using any appropriate medium, including but not limited to wireless, wireline, optical fiber cable, RF, etc., or any suitable combination of the foregoing.

Computer program code for carrying out operations for aspects of the present invention may be written in any combination of one or more programming languages, including an object oriented programming language such as Java, Smalltalk, C++ or the like and conventional procedural programming languages, such as the "C" programming language or similar programming languages. The program code may execute entirely on the user's computer, partly on the user's computer, as a stand-alone software package, partly on the user's computer and partly on a remote computer or entirely on the remote computer or server. In the latter scenario, the remote computer may be connected to the user's computer through any type of network, including a local area network (LAN) or a wide area network (WAN), or the connection may be made to an external computer (for example, through the Internet using an Internet Service Provider).

These computer program instructions may also be stored in a computer readable medium that can direct a computer, other programmable data processing apparatus, or other devices to function in a particular manner, such that the instructions stored in the computer readable medium produce an article of manufacture including instructions which implement the function/act specified herein.

The computer program instructions may also be loaded onto a computer, other programmable data processing apparatus, or other devices to cause a series of operational steps to be performed on the computer, other programmable apparatus or other devices to produce a computer implemented process such that the instructions which execute on the computer or other programmable apparatus provide processes for implementing the functions/acts specified herein.

Examples

Gene Selection to Build the Prostate Cancer PDE Index (PDE-Index):

To select gene candidates to build the PDE-Index various PDE4D transcripts (out of currently nine annotated PDE isoforms PDE4D1 to PDE4D9) were investigated for correlation of the putative prognostic gene marker PDE4D7 as described in WO2010131194 and WO2010131195.

To Build the Prostate Cancer PDE Index the Following Data Sets were Used:
1) Taylor B S et al. Integrative Genomic Profiling of Human Prostate Cancer. Cancer Cell 18, 11-22, 2010 (GEO data set ID: GSE21032)
2) Boormans J L et al. Identification of TDRD1 as a direct target gene of ERG in primary prostate cancer. Int J Cancer 2013 Jul. 15; 133(2):335-45 (GEO data set ID: GSE41408)
3) Brase J C et al; TMPRSS2-ERG-specific transcriptional modulation is associated with prostate cancer biomarkers and TGF-b signaling. BMC Cancer 2011, 11, 507-515 (GEO data set ID: GSE29079)

To Further Test and Validate the Built Prostate Cancer PDE Index the Following Data Set was Used:
1) Erho N et al. Discovery and Validation of a Prostate Cancer Genomic Classifier that Predicts Early Metastasis Following Radical Prostatectomy. PLoS One 8(6), e66855 (2013) (GEO data set ID: GSE46691)

Processing of GSE Gene Expression Data

Respective CEL files were downloaded from GEO (Gene Expression Omnibus): http://www.ncbi.nlm.nih.gov/geo/. The CEL file data were uploaded into Expression Console (Affymetrix Inc; Build 1.3.1.187) and were pre-processed using the appropriate probe set annotation files provided by Affymetrix Inc. where appropriate, i.e., data sets run on an Affymetrix Inc platform: GSE21032, GSE41408, GSE25136.

The expression values of the individual PDE4D isoforms PDE4D1-PDE4D9 were estimated by using the exon array signal values of the probe sets of the Affymetrix Human Exon 1.0 ST Array as outlined in FIG. 1. Note: for the interrogation of the expression of the very closely related isoforms PDE4D1 and PDE4D2 only a single probe set was used and the corresponding activity was reported for both isoforms together (PDE4D1&2). For all other PDE4D transcripts several probe sets were used to calculate the respective isoform expression which is reported as the mean of the different probe sets measured for a single PDE4D variant.

qRT-PCR (Quantitative Real-Time PCR) Data Normalization Procedure

Reference genes are supposed to have a stable expression independently of the sample being processed and therefore can be used as an internal standard to normalize the output Cq values of a PCR analysis so that the results are comparable independently of the amount of input sample used. Though such genes are supposed to be stable, there is always some variability in their expression, and this stability can also depend on the tissue being analyzed. For such reason it is recommended to use more than one reference gene in the normalization of PCR Cq values and to use a set of genes that presents low variability in the specific type of tissue/sample being analyzed C. L. Andersen, J. L. Jensen, and T. F. Ørntoft, "Normalization of Real-Time Quantitative Reverse Transcription-PCR Data: A Model-Based Variance Estimation Approach to Identify Genes Suited for Normalization, Applied to Bladder and Colon Cancer Data Sets," *Cancer Res., vol.* 64, no. 15, pp. 5245-5250, August 2004, J. Vandesompele, K. De Preter, F. Pattyn, B. Poppe, N. Van Roy, A. De Paepe, and F. Speleman, "Accurate normalization of real-time quantitative RT-PCR data by geometric averaging of multiple internal control genes," *Genome Biol., vol.* 3, no. 7, p. RESEARCH0034, June 2002).

An initial selection of 9 reference genes to be used in this study was performed. Final selection of reference gene set used for normalization was done by running the with the Biogazelle Software tool (qBase+ with GeNorm analysis J. Hellemans, G. Mortier, A. D. Paepe, F. Speleman, and J. Vandesompele, "qBase relative quantification framework and software for management and automated analysis of real-time quantitative PCR data," *Genome Biol., vol.* 8, no. 2, p. R19, February 2007) on all the analyzed clinical samples.

The output Cq values of a PCR assay are intrinsically logarithmic (base 2) and inversely proportional to the amount of mRNA present in the sample. We use the following formula to normalize the raw Cq values:

$$N(Cq_{gene\ of\ interest}) = \text{Mean}(Cq_{ref\ gene}) - (Cq_{gene\ of\ interest})$$

Where $N(Cq_{gene\ of\ interest})$ is normalized gene expression value for a gene of interest; where $\text{Mean}(Cq_{ref\ gene})$ is the arithmetic mean of the PCR Cq values of the selected combination of reference genes; where $(Cq_{gene\ of\ interest})$ is the PCR Cq value of the gene of interest.

In case other technologies than qRT-PCR are used to measure the expression of the reference genes or the genes of interest the PCR Cq value will be replaced by a normalized measurement of the respective technology (e.g., a RMA (Robust Multi-array Average) normalized gene expression value for DNA microarrays, or a FPKM (Fragments Per Kilobase of Exon Per Million Fragments Mapped) normalized gene expression value for RNA sequencing).

Figure 11:
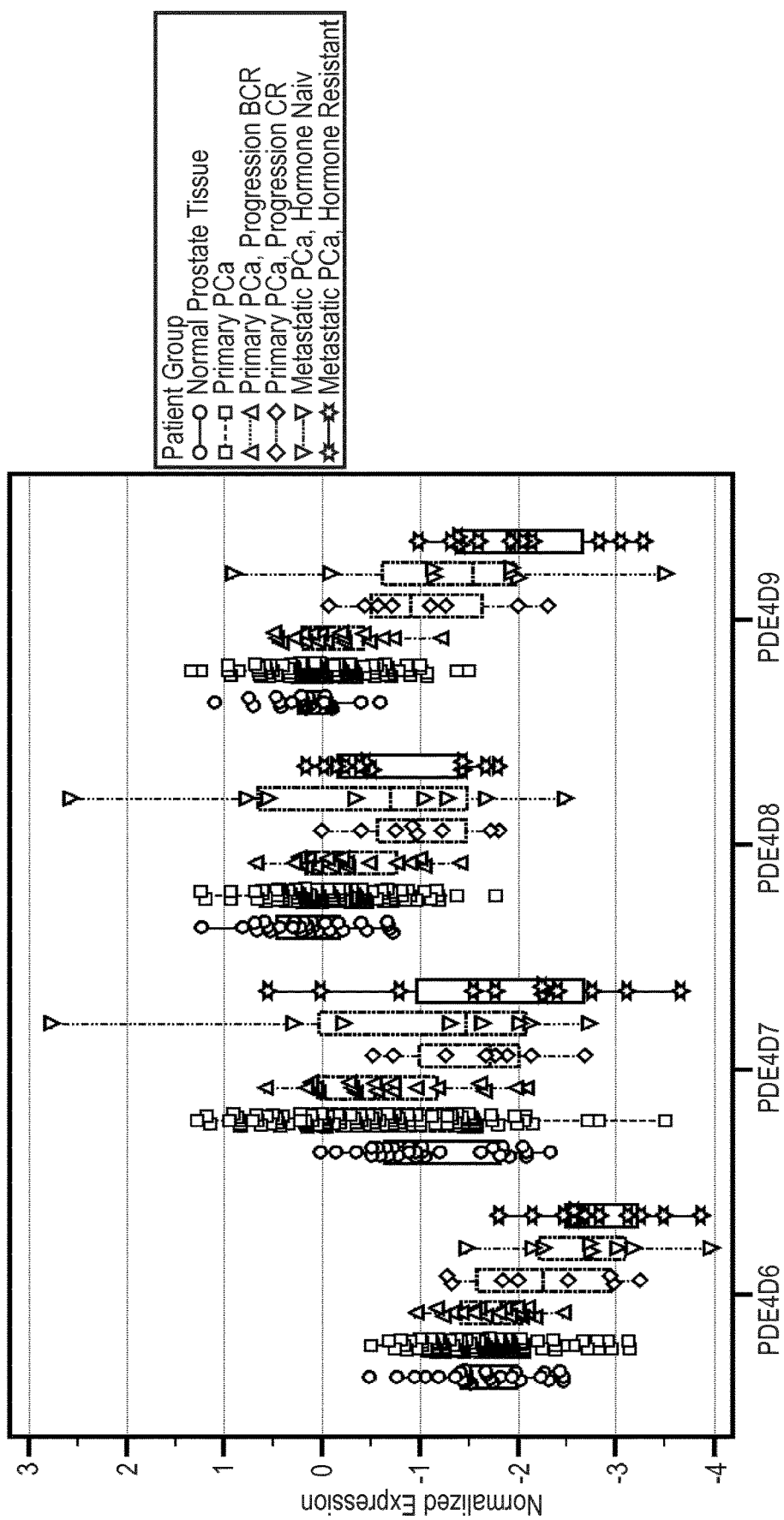
FIG. 11 shows the normalized expression of PDE4D6, PDE4D7, PDE4D8 and PDE4D9 across six different prostate cancer tissue types in the data set Taylor et al., Integrative Genome Profiling of Human Prostate Cancer, Cancer Cell 18, 11-22, 2010 (GSE21034 (NCBI GEO)).
Figure 12:
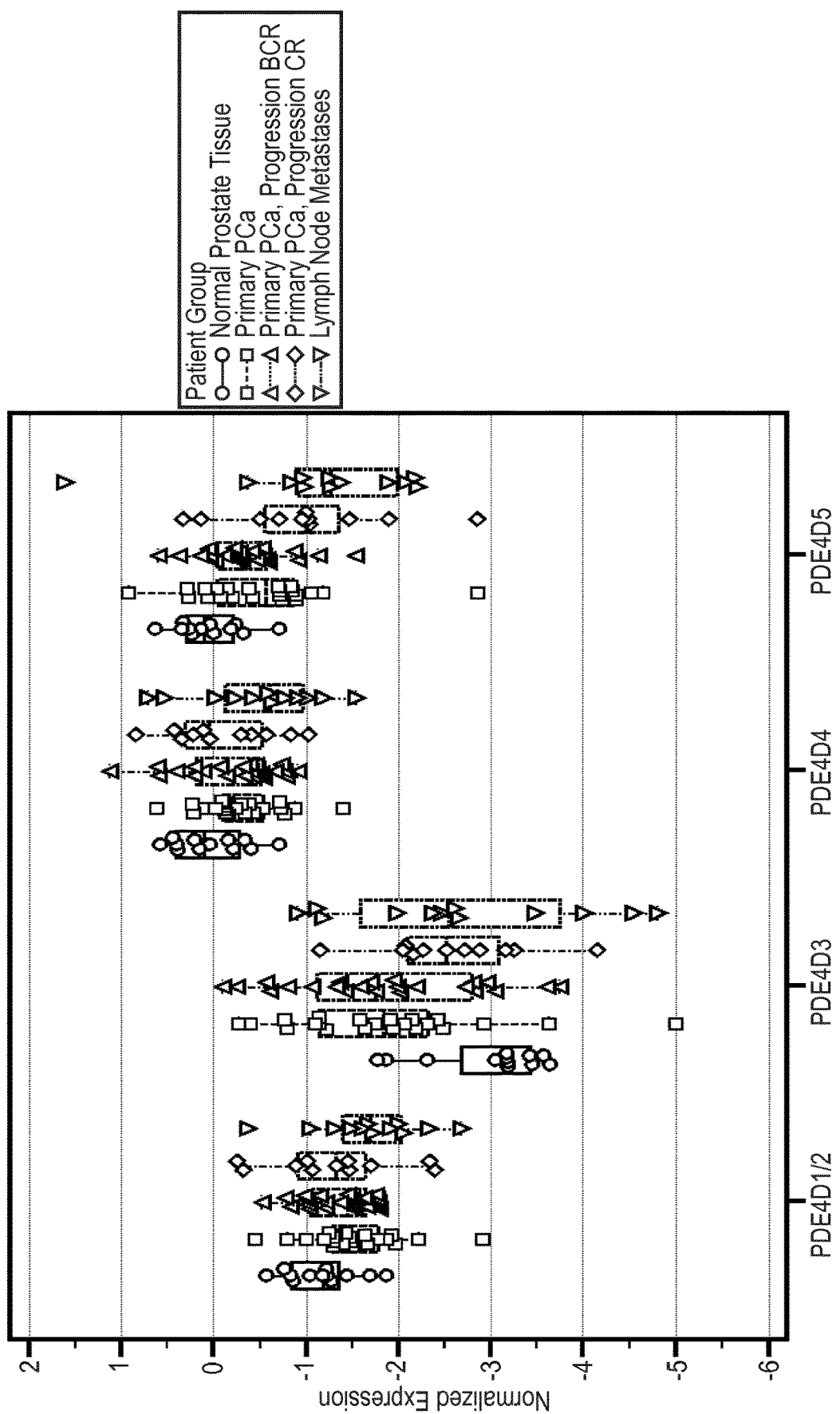
FIG. 12 shows the normalized expression of PDE4D1/2, PDE4D3, PDE4D4 and PDE4D5 across six different prostate cancer tissue types in the data set Boormans et al., Identification of TDRD1 as a direct target gene of ERG in primary prostate cancer, Int J Cancer 2013 Jul. 15; 133(2): 335-45 (GSE41410 (NCBI GEO)).
Figure 13:
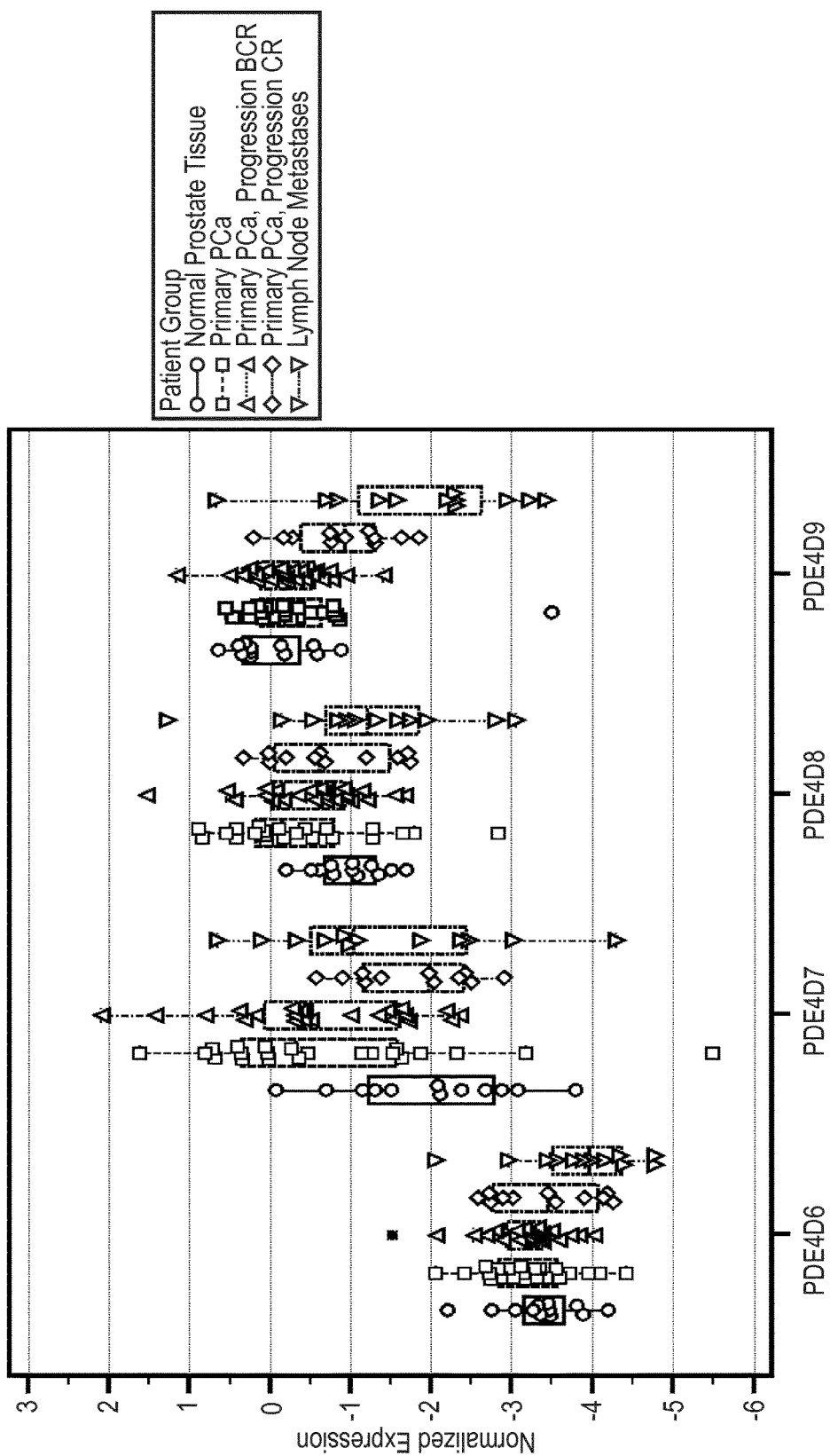
FIG. 13 shows the normalized expression of PDE4D6, PDE4D7, PDE4D8 and PDE4D9 across six different prostate cancer tissue types in the data set Boormans et al., Identification of TDRD1 as a direct target gene of ERG in primary prostate cancer, Int J Cancer 2013 Jul. 15; 133(2): 335-45 (GSE41410 (NCBI GEO)).

Normalized expression levels of the PDE4D transcripts across different prostate cancer tissues of the two data sets Taylor et al, Integrative Genome Profiling of Human Prostate Cancer, Cancer Cell 18, 11-22, 2010 (GSE21034 (NCBI GEO)) and Boormans et al., Identification of TDRD1 as a direct target gene of ERG in primary prostate cancer, Int J Cancer 2013 Jul. 15; 133(2):335-45 (GSE41410 (NCBI GEO)) are shown in FIGS. 10 to 13. The expression of the transcripts has been normalized to the following reference genes: HPRT1, PUM1, TBP, and TUBA1B. The used data is based on publically available exon array expression data, i.e., for each gene a range of exon probe sets directed to various exons of the respective gene measure the expression of the different exons as outlined above. In the first step the log 2 expression of all probe sets for the reference genes are used to calculate an averaged reference gene expression. The same is done for the different probe sets targeting the individual 4D transcripts. Then the average of the reference genes is subtracted from the averaged 4D transcript expression. The result is the normalized PDE4D transcript expression. As can be seen, the different 4D transcripts are regulated in an isoform specific manner across the different tissues (ranging from normal prostate, primary prostate cancer with different potential to progress after primary treatment (BCR=biochemical recurrence; CR=clinical recurrence to metastases) to metastatic tissue (hormone naïve, i.e., before any anti-androgen therapy; and hormone resistant, i.e., after anti-androgen therapy). For instance, PDE4D3 and PDE4D6 are not highly expressed compared to other 4D transcripts; PDE4D4 is not really changed across tissues; PDE4D5 and PDE4D9 are down-regulated from normal to hormone resistant tissues while PDE4D7 is overexpressed in primary prostate cancer and then becomes again more down-regulated across the other tissues.

PDE-Index Computation (Based on Quantitative Real-Time PCR Data)

i) PDE-Index_1: PDE4D7_exp-PDE4D5_exp,
where
PDE4D7_exp is $(N(Cq_{PDE4D7}))$, and PDE4D5_exp is $(N(Cq_{PDE4D5}))$ ii) PDE-Index_2: MEAN(PDE4D7_exp & PDE4D5_exp),
where
PDE4D7_exp is $(N(Cq_{PDE4D7}))$, and PDE4D5_exp is $(N(Cq_{PDE4D5}))$ iii) PDE-Index_3: (MEAN(PDE4D5_exp & PDE4D7_exp & PDE4D9_exp))/(PDE4D4_exp)
where
PDE4D5_exp is $(N(Cq_{PDE4D5}))$, PDE4D7_exp is $(N(Cq_{PDE4D7}))$, PDE4D9_exp is $(N(Cq_{PDE4D9}))$, and PDE4D4_exp is $(N(Cq_{PDE4D4}))$
and where
(MEAN(PDE4D5_exp & PDE4D7_exp & PDE4D9_exp)) is the arithmetic mean of PDE4D5_exp, PDE4D7_exp, and PDE4D9_exp iv) PDE-Index_4: (MEAN(PDE4D5_exp & PDE4D7_exp & PDE4D9_exp))/(PDE4D1&PDE4D2_exp)
where
PDE4D5_exp is $(N(Cq_{PDE4D5}))$, PDE4D7_exp is $(N(Cq_{PDE4D7}))$, PDE4D9_exp is $(N(Cq_{PDE4D9}))$, and PDE4D1&PDE4D2_exp is $(N(Cq_{PDE4D1\_2}))$
and where
(MEAN(PDE4D5_exp & PDE4D7_exp & PDE4D9_exp)) is the arithmetic mean of PDE4D5_exp, PDE4D7_exp, and PDE4D9_exp v) PDE-Index_5: (MEAN(PDE5_exp & PDE7_exp & PDE4D9_exp))
where
PDE4D5_exp is $(N(Cq_{PDE4D5}))$, PDE4D7_exp is $(N(Cq_{PDE4D7}))$, and PDE4D9_exp is $(N(Cq_{PDE4D9}))$
and where
(MEAN(PDE4D5_exp & PDE4D7_exp & PDE4D9_exp)) is the arithmetic mean of PDE4D5_exp, PDE4D7_exp, and PDE4D9_exp The calculated PDE-Indices were used for any further statistical data analysis.

Correlation Analysis of the PDE-Index Vs. Clinical Parameters to Patient Outcome All statistical analysis (e.g., logistic regression analysis, ROC analysis, COX regression analysis, etc.) of the PDE-Index and its correlation to patient outcome in comparison to clinical parameters like PSA, pGleason, pT Stage was performed with XLSTAT Version 2014.1.03

Results

FIG. 3 shows an overview over the differential normalized expression of the individual PDE4D isoforms as well as the four variants of the PDE-Indices for different patient group comparisons across two gene expression data sets. The pairwise patient comparisons analyzed were as follows:

i) NAT vs. Primary PCa, NP
ii) Primary PCa, NP vs. Primary PCa, BCR&CR
iii) Primary PCa, NP&BCR vs. Primary PCa, CR
iv) Primary PCa (all) vs. Metastases
v) Primary PCa (all) vs. CRPC Wherein, NAT is normal adjacent tissue, i.e., tissue collected next to a tumor lesion from patient material but cancer free on histology Primary PCa, NP is primary tumor tissue collected from patient that did not show tumor progression during clinical follow-up Primary PCa, BCR&CR is primary tumor tissue collected from patient that did show tumor progression during clinical follow-up to first biochemical and subsequently clinical recurrence Primary PCa, NP&BCR is primary tumor tissue collected from patient that either did not show tumor progression during clinical follow-up or demonstrated first biochemical recurrence Primary PCa, CR is primary tumor tissue collected from patient that either did show tumor progression during clinical follow-up to clinical recurrence Metastases is metastatic tumor tissue collected from a hormone-naïve patient CRPC is tissue collected from a patient with castration resistant disease As can be seen from the data the various PDE-Indices can be used for different applications in diagnosis of prostate cancer and/or prognosis of prostate cancer progression. The variant PDE-Index Variant_1: PDE4D7_Expression-PDE4D5_Expression is mostly useful to discriminate between normal adjacent tissue (NAT) and primary cancerous tissue of the prostate with very high discrimination power (see FIG. 3). Calculation of this index in various other data sets for discrimination between NAT and primary prostate cancer compared to the other PDE-Index variants (see FIG. 4) confirms that PDE-Index Variant_1 provides a strong discrimination power. The abbreviation "BL" indicates benign lesions and "H" indicates benign hyperplasia of the prostate.

FIG. 5 provides an overview over in total eight prostate cancer data sets comprising in total >900 patient samples from the categories of normal adjacent tissue, benign lesions, benign hyperplasia, as well as tumour tissue. All pairwise comparisons between different tissue categories demonstrate a very high discrimination power between the tissue groups by using the PDE-Index Variant_1.

As can be further seen from FIG. 3 the PDE-Index variants PDE-Index_2, PDE-Index_3 and PDE-Index_4 are correlated to more aggressive disease.

PDE-Index_2 (PDE-Index Variant_2):
MEAN(PDE4D7_exp & PDE4D5_exp)
PDE-Index_3 (PDE-Index Variant_3):
(MEAN(PDE4D5_exp & PDE4D7_exp & PDE4D9_exp))/(PDE4D4_exp)
PDE-Index_4 (PDE-Index Variant_4):
(MEAN(PDE4D5_exp & PDE4D7_exp & PDE4D9_exp))/(PDE4D1&PDE4D2_exp)
PDE-Index_5 (PDE-Index Variant_5):
(MEAN(PDE4D5_exp & PDE4D7_exp & PDE4D9_exp))

Wherein the term "PDE4D4_exp" denotes the expression level of PDE4D4, the term "PDE4D5_exp" denotes the expression level of PDE4D5, the term "PDE4D7_exp" denotes the expression level of PDE4D7 and the term "PDE4D9_exp" denotes the expression level of PDE4D9. The term "PDE4D1&PDE4D2_exp" denotes the expression levels of PDE4D1 and PDE4D2, detected together by a single probe.

The pairwise comparisons of the following patient groups generally deliver significant expression difference (see FIG. 3):

i) Primary PCa, NP vs. Primary PCa, BCR&CR
ii) Primary PCa, NP&BCR vs. Primary PCa, CR
iii) Primary PCa (all) vs. Metastases
iv) Primary PCa (all) vs. CRPC This is further supported by a ROC analysis as outlined for the PDE-Indices 2-4 in FIG. 6. The AUC (Area under the Curve) of the ROC analysis for the above pairwise comparisons demonstrate a positive discrimination power. This data underlines the prognostic power of the combinations of various PDE4D transcripts to predict progressive prostate cancer.

We also tested the various PDE-indices for the differential expression between TMPRSS2-ERG negative and TMRSS2-ERG positive tumors compared to normal adjacent tissue (NAT, TMRPSS2-ERG negative). The results are summarized in FIG. 7. It is interesting to note that we observed a strong correlation between the presence of positive TMPRSS2-ERG gene fusion and the expression of the PDE4D7 isoform while other PDE4D transcript (in particular PDE4D1&2, PDE4D5, and PDE4D9) expression is more correlated to the absence of the TMPRSS2-ERG gene fusion. This effect is very strong for PDE4D5. This observation—i.e., positive expression correlation of PDE4D7 presence of the TMPRSS2-ERG gene fusion and positive correlation of PDE4D5 expression with absence of TMPRSS2-ERG gene fusion—with which is confirmed in four independent prostate cancer data sets (FIG. 7) provides a very strong rational for the combination of PDE4D5 and PDE4D7 into PDE-Index Variant_1 to represent a strong discriminator between cancer and non-cancerous prostate tissue (see also FIG. 5).

Further we analyzed the correlation of the PDE-Index variants to pathology Gleason score in a prostate cancer data set. The analysis was performed depending on the status of the prostate cancer specific gene fusion TMPRSS2-ERG (Tomlins S. et al, Nature, 2005). This genomic rearrangement between the androgen regulated serine protease TMPRSS2 and the transcription factor ERG2 which is a member of the ETS transcription factor family. As outlined in FIG. 8 there was a significant positive association with the PDE-Indices 2-4 and the presence of the TMPRSS2-ERG fusion.

FIG. 9 represents an overview of the added value of the PDE-Indices together with clinical data on the progression free survival (biochemical and clinical) depending on the TMPRSS2-ERG fusion status of the tumor. The added value is seen in the increase of AUC in the ROC analysis from the clinical model alone (pGleason & pT Stage) vs. a combination model of PDE-Index & pGleason & pT Stage. It is of note that a significant increase in AUC could only be detected for the investigated PDE-Index variants in case of presence of the TMPRSS2-ERG fusion for both tested endpoints, namely biochemical progression free survival as well as clinical progression free survival.

SEQUENCE LISTING (82 sequences)

SEQ ID NO: 1 - DNA, 7801 bp, Homo sapiens
gtggtggccgcgcacccggccgcggctgattcattcacttcaagtgccgtgcagaaggctcggcaggcggggcgggcgtggggccgcggctccgggttggggaccgaggagatccggctgtggaccagacgctcctctgcggggcgggcacccaagcgcgctcgccaccccctcgccatccgctagagccgggctcctggactgggactcgggcccgccgcacagttgaaaagtcgcatagtggtttttccgctcgcgtcgctgtgtgaaagttggctcgccgctctttgcacgccctccctggaggccgacccgagacgccaagctggagagaccgtgcctccccgaggccggccgccccgcgagcacagcctccgcccccgttgcactgccgggctgggcaatatgaaggagcagccctcatgtgccggcaccgggcatccgagcatggcggggtatggcaggatggccccctttgaactcgctagcggacccgtgaagcgcttgagaactgagtccccctttccctgtctcttcgcagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgtcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatacttttatgtgtgttatatcaaatgtgtcttaagcttcatgcaaactcagtcatcagttcgtgttgtctgaagcaagtgggagatatataaatacccagtagctaaaatggtcagtcttttttagatgttttcctacttagtatctcctaataacgttttgctgtgtcactagatgttcatttcacaagtgcatgtctttctaataatccacacatttcatgctctaataatccacacatttcatgctcatttttattgtttttacagccagttatagtaagaaaaaggtttttccccttgtgctgctttataatttagcgtgtgtctgaaccttatccatgtttgctagatgaggtcttgtcaaatatatcactaccattgtcaccggtgaaaagaaacaggtagttaagttagggttaacattcatttcaaccacgaggttgtatatcatgactagcttttactcttggtttacagagaaaagttaaacagccaactaggcagtttttaagaatattaacaatatattaacaaacaccaatacaactaatcctatttggttttaatgatttcaccatgggattaagaactatatcaggaacatccctgagaaacggttttaagtgtagcaactactcttccttaatggacagccacataacgtgtaggaagtcctttatcacttatcctcgatccataagcatatcttgcagaggggaactacttctttaaacacatggagggaaagaagatgatgccactggcaccagagggttagtactgtgatgcatcctaaaatatttattatattggtaaaaattctggttaaataaaaaattagagatcactcttggctgatttcagcaccaggaactgtattacagttttagagattaattcctagtgtttacctgattatagcagttggcatcatggggcatttaattctgactttatccccacgtcagccttaataaagtcttctttaccttctctatgaagactttaaagcccaaataatcatttttcacattgatattcaagaattgagatagatagaagccaaagtgggtatctgacaagtggaaaatcaaacgtttaagaagaattacaactctgaaaagcatttatatgtggaacttctcaaggagcctcctggggactggaaagtaagtcatcagccaggcaaatgactcatgctgaagagagtccccatttcagtcccctgagatctagctgatgcttagatcctttgaaataaaaattatgtctttataactctgatcttttacataaagcagaagaggaatcaactagttaattgcaaggtttctactctgtttcctctgtaaagatcagatggtaatctttcaaataagaaaaaaataaagacgtatgtttgaccaagtagtttcacaagaatatttgggaacttgtttcttttaattttatttgtccctgagtgaagtctagaaagaaaggtaaagagtctagagtttattcctctttccaaaacattctcattcctctcctccctacacttagtatttcccccacagagtgcctagaatcttaataatgaataaaataaaaagcagcaatatgtcattaacaaatccagacctgaaagggtaaagggtttataactgcactaataaagagaggctctttttttttcttccagtttgttggtttttaatggtaccgtgttgtaaagatacccactaatggacaatcaaattgcagaaaaggctcaatatccaagagacagggactaatgcactgtacaatctgcttatccttgcccttctctcttgccaaagtgtgcttcagaaatatatactgctttaaaaaagaataaaagaatatccttttacaagtggctttacatttcctaaaatgccataagaaaatgcaatatctgggtactgtatggggaaaaaaatgtccaagtttgtgtaaaaccagtgcatttcagcttgcaagttactgaacacaataatgctgttttaattttgttttatatcagttaaaattcacaataatgtagatagaacaaattacagacaaggaaagaaaaaacttgaatgaaatggattttacagaaagctttatgataatttttgaatgcattatttattttttgtgccatgcattttttttctcaccaaatgaccttacctgtaatacagtcttgtttgtctgtttacaaccatgtatttattgcaatgtacatactgtaatgttaattgtaaattatctgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttgcatttgattatttcctttttttttttttttaactcggaaacacaactggggaaatatattctttcccagtgattataaacaatctttttcttttttttaagtccttttggcttctagagctcataggaaaatggacttgatttgaaattggagccagagtttactcgtgttggttatctattcatcagcttcctgacatgttaagagaatacattaaagagaaaatactgttttttaatcctaaaatttttcttccactaagataaaccaaatgtccttacatatatgtaaacccatctatttaaacgcaaaggtgggttgatgtcagtttacatagcagaaagcattcactatcctctaagatttgtttctgcaaaactttcattgctttagaattttaaaatttcaccttgtacaatggccagcccctaaagcaggaaacatttataatggattatatggaaacatcctcccagtacttgcccagcccttgaatcatgtggcttttcagtgaaaggaaagattctttttctaggaaaaatgagcctattttattttattttattttattttttgacacaaactgtagattttagcagccctggcccaaaggaatttgattacttttgttttaaacagtacaaaggggacactataattacaaaaacatccttaactgatttgagttgtttttatttctttggatatattttcagagtggtaaattgtgtgtgagaattacaaatgattattcttttagtggtttcttagcctctcttacagcccacggggatagtactgtacatcaataccttcatatgaaatttttatatgcaatgaaaataaaagcatgggttgattctgcctatttatgactcaatcttttacaaataaaagattattcattttaaattatagttcaatcagcatgtctcttaggatactgaacgtggttgaaatgaaaggatagtgacatcataagttagtactgatattcataaccaaataaagccaacttgagtaattttgctacattaaaaattaccaaaattacttagatggcctataagattaagcatggtgttttctaagcaagctttgaaaggggccttccatacttacttaattgaatattctgggatattgaaaattattcagatacttgacaattatttttggttacctactccgcaaactacaaagttttaaggactcaacaataagttaatgagacacagtgtttgctttcatggagcttacagtctggaggggacaaaggcttaaacaatactcatataattatatatgtgatcagtacaatgaaggagctcagtggggtaaataagcaggaacctgaacttgatctgttccggagggccacagaaggcttccttgaggccttgagaaagtgatttgcatctgagttctgaaggattgtaagaggtaactagggaaaaagttgacaggaagaggaaggggatccagacaagaaacatttgcaaagatcttgaggcataaatgagcttgagacatctggagaaactgaggaaaagtgagagagtaggcagggcctggagccgcagagccattgctaaccatcctgtgtgagatatcccccattctgtagctttattctcataaccctgctcaattttctttataacacttctcacagatttatatacgtgtttgtttttgttatctgtctctcccaccagaccacagctccatgagagcaaggtctttgcttaccaatatatcactagcacttaaaactatgcctggtacacagtaggttcttaatatgtgttgaatatagccatcaaattgatattggatataattcaatctgataagatattttgagatattaaagagtttttaacttgataccataaaaaaaaaaaaaaaaa

SEQ ID NO: 2 - protein, 585 aa, Homo sapiens
MKEQPSCAGTGHPSMAGYGRMAPFELASGPVKRLRTESPFPCLFAEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 3 - DNA, 7715 bp, Homo sapiens
gtggtggccgcgcacccggccgcggctgattcattcacttcaagtgccgtgcagaaggctcggcaggcggggcgggcgtggggccgcggctccgggttggggaccgaggagatccggctgtggaccagacgctcctctgcggggcgggcacccaagcgcgctcgccaccccctcgccatccgctagagccgggctcctggactgggactcgggcccgccgcacagttgaaaagtcgcatagtggtttttccgctcgcgtcgctgtgtgaaagttggctcgccgctctttgcacgccctccctggaggccgacccgagacgccaagctggagagaccgtgcctccccgaggccggccgccccgcgagcacagcctccgcccccgttgcactgccgggctgggcaatatgaaggagcagccctcatgtgccggcaccgggcatccgagcatggcgggaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgtcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatacttttatgtgtgttatatcaaatgtgtcttaagcttcatgcaaactcagtcatcagttcgtgttgtctgaagcaagtgggagatatataaatacccagtagctaaaatggtcagtcttttttagatgttttcctacttagtatctcctaataacgttttgctgtgtcactagatgttcatttcacaagtgcatgtctttctaataatccacacatttcatgctctaataatccacacatttcatgctcatttttattgtttttacagccagttatagtaagaaaaaggtttttccccttgtgctgctttataatttagcgtgtgtctgaaccttatccatgtttgctagatgaggtcttgtcaaatatatcactaccattgtcaccggtgaaaagaaacaggtagttaagttagggttaacattcatttcaaccacgaggttgtatatcatgactagcttttactcttggtttacagagaaaagttaaacagccaactaggcagtttttaagaatattaacaatatattaacaaacaccaatacaactaatcctatttggttttaatgatttcaccatgggattaagaactatatcaggaacatccctgagaaacggttttaagtgtagcaactactcttccttaatggacagccacataacgtgtaggaagtcctttatcacttatcctcgatccataagcatatcttgcagaggggaactacttctttaaacacatggagggaaagaagatgatgccactggcaccagagggttagtactgtgatgcatcctaaaatatttattatattggtaaaaattctggttaaataaaaaattagagatcactcttggctgatttcagcaccaggaactgtattacagttttagagattaattcctagtgtttacctgattatagcagttggcatcatggggcatttaattctgactttatccccacgtcagccttaataaagtcttctttaccttctctatgaagactttaaagcccaaataatcatttttcacattgatattcaagaattgagatagatagaagccaaagtgggtatctgacaagtggaaaatcaaacgtttaagaagaattacaactctgaaaagcatttatatgtggaacttctcaaggagcctcctggggactggaaagtaagtcatcagccaggcaaatgactcatgctgaagagagtccccatttcagtcccctgagatctagctgatgcttagatcctttgaaataaaaattatgtctttataactctgatcttttacataaagcagaagaggaatcaactagttaattgcaaggtttctactctgtttcctctgtaaagatcagatggtaatctttcaaataagaaaaaaataaagacgtatgtttgaccaagtagtttcacaagaatatttgggaacttgtttcttttaattttatttgtccctgagtgaagtctagaaagaaaggtaaagagtctagagtttattcctctttccaaaacattctcattcctctcctccctacacttagtatttcccccacagagtgcctagaatcttaataatgaataaaataaaaagcagcaatatgtcattaacaaatccagacctgaaagggtaaagggtttataactgcactaataaagagaggctctttttttttcttccagtttgttggtttttaatggtaccgtgttgtaaagatacccactaatggacaatcaaattgcagaaaaggctcaatatccaagagacagggactaatgcactgtacaatctgcttatccttgcccttctctcttgccaaagtgtgcttcagaaatatatactgctttaaaaaagaataaaagaatatccttttacaagtggctttacatttcctaaaatgccataagaaaatgcaatatctgggtactgtatggggaaaaaaatgtccaagtttgtgtaaaaccagtgcatttcagcttgcaagttactgaacacaataatgctgttttaattttgttttatatcagttaaaattcacaataatgtagatagaacaaattacagacaaggaaagaaaaaacttgaatgaaatggattttacagaaagctttatgataatttttgaatgcattatttattttttgtgccatgcattttttttctcaccaaatgaccttacctgtaatacagtcttgtttgtctgtttacaaccatgtatttattgcaatgtacatactgtaatgttaattgtaaattatctgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttgcatttgattatttcctttttttttttttttaactcggaaacacaactggggaaatatattctttcccagtgattataaacaatctttttcttttttttaagtccttttggcttctagagctcataggaaaatggacttgatttgaaattggagccagagtttactcgtgttggttatctattcatcagcttcctgacatgttaagagaatacattaaagagaaaatactgttttttaatcctaaaatttttcttccactaagataaaccaaatgtccttacatatatgtaaacccatctatttaaacgcaaaggtgggttgatgtcagtttacatagcagaaagcattcactatcctctaagatttgtttctgcaaaactttcattgctttagaattttaaaatttcaccttgtacaatggccagcccctaaagcaggaaacatttataatggattatatggaaacatcctcccagtacttgcccagcccttgaatcatgtggcttttcagtgaaaggaaagattctttttctaggaaaaatgagcctattttattttattttattttattttttgacacaaactgtagattttagcagccctggcccaaaggaatttgattacttttgttttaaacagtacaaaggggacactataattacaaaaacatccttaactgatttgagttgtttttatttctttggatatattttcagagtggtaaattgtgtgtgagaattacaaatgattattcttttagtggtttcttagcctctcttacagcccacggggatagtactgtacatcaataccttcatatgaaatttttatatgcaatgaaaataaaagcatgggttgattctgcctatttatgactcaatcttttacaaataaaagattattcattttaaattatagttcaatcagcatgtctcttaggatactgaacgtggttgaaatgaaaggatagtgacatcataagttagtactgatattcataaccaaataaagccaacttgagtaattttgctacattaaaaattaccaaaattacttagatggcctataagattaagcatggtgttttctaagcaagctttgaaaggggccttccatacttacttaattgaatattctgggatattgaaaattattcagatacttgacaattatttttggttacctactccgcaaactacaaagttttaaggactcaacaataagttaatgagacacagtgtttgctttcatggagcttacagtctggaggggacaaaggcttaaacaatactcatataattatatatgtgatcagtacaatgaaggagctcagtggggtaaataagcaggaacctgaacttgatctgttccggagggccacagaaggcttccttgaggccttgagaaagtgatttgcatctgagttctgaaggattgtaagaggtaactagggaaaaagttgacaggaagaggaaggggatccagacaagaaacatttgcaaagatcttgaggcataaatgagcttgagacatctggagaaactgaggaaaagtgagagagtaggcagggcctggagccgcagagccattgctaaccatcctgtgtgagatatcccccattctgtagctttattctcataaccctgctcaattttctttataacacttctcacagatttatatacgtgtttgtttttgttatctgtctctcccaccagaccacagctccatgagagcaaggtctttgcttaccaatatatcactagcacttaaaactatgcctggtacacagtaggttcttaatatgtgttgaatatagccatcaaattgatattggatataattcaatctgataagatattttgagatattaaagagtttttaacttgataccataaaaaaaaaaaaaaaaa

SEQ ID NO: 4 - protein, 507 aa, Homo sapiens
MASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 5 - DNA, 7783 bp, Homo sapiens
aatacttgttgcaataattgcccacgatagctgctcaaacaagagagttggaattcatctgtaaaaatcactacatgtaacgtaggagacaagaaaaatattaatgacagaagatctgcgaacatgatgcacgtgaataattttccctttagaaggcattcctggatatgttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgtcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatacttttatgtgtgttatatcaaatgtgtcttaagcttcatgcaaactcagtcatcagttcgtgttgtctgaagcaagtgggagatatataaatacccagtagctaaaatggtcagtcttttttagatgttttcctacttagtatctcctaataacgttttgctgtgtcactagatgttcatttcacaagtgcatgtctttctaataatccacacatttcatgctctaataatccacacatttcatgctcatttttattgtttttacagccagttatagtaagaaaaaggtttttccccttgtgctgctttataatttagcgtgtgtctgaaccttatccatgtttgctagatgaggtcttgtcaaatatatcactaccattgtcaccggtgaaaagaaacaggtagttaagttagggttaacattcatttcaaccacgaggttgtatatcatgactagcttttactcttggtttacagagaaaagttaaacagccaactaggcagtttttaagaatattaacaatatattaacaaacaccaatacaactaatcctatttggttttaatgatttcaccatgggattaagaactatatcaggaacatccctgagaaacggttttaagtgtagcaactactcttccttaatggacagccacataacgtgtaggaagtcctttatcacttatcctcgatccataagcatatcttgcagaggggaactacttctttaaacacatggagggaaagaagatgatgccactggcaccagagggttagtactgtgatgcatcctaaaatatttattatattggtaaaaattctggttaaataaaaaattagagatcactcttggctgatttcagcaccaggaactgtattacagttttagagattaattcctagtgtttacctgattatagcagttggcatcatggggcatttaattctgactttatccccacgtcagccttaataaagtcttctttaccttctctatgaagactttaaagcccaaataatcatttttcacattgatattcaagaattgagatagatagaagccaaagtgggtatctgacaagtggaaaatcaaacgtttaagaagaattacaactctgaaaagcatttatatgtggaacttctcaaggagcctcctggggactggaaagtaagtcatcagccaggcaaatgactcatgctgaagagagtccccatttcagtcccctgagatctagctgatgcttagatcctttgaaataaaaattatgtctttataactctgatcttttacataaagcagaagaggaatcaactagttaattgcaaggtttctactctgtttcctctgtaaagatcagatggtaatctttcaaataagaaaaaaataaagacgtatgtttgaccaagtagtttcacaagaatatttgggaacttgtttcttttaattttatttgtccctgagtgaagtctagaaagaaaggtaaagagtctagagtttattcctctttccaaaacattctcattcctctcctccctacacttagtatttcccccacagagtgcctagaatcttaataatgaataaaataaaaagcagcaatatgtcattaacaaatccagacctgaaagggtaaagggtttataactgcactaataaagagaggctctttttttttcttccagtttgttggtttttaatggtaccgtgttgtaaagatacccactaatggacaatcaaattgcagaaaaggctcaatatccaagagacagggactaatgcactgtacaatctgcttatccttgcccttctctcttgccaaagtgtgcttcagaaatatatactgctttaaaaaagaataaaagaatatccttttacaagtggctttacatttcctaaaatgccataagaaaatgcaatatctgggtactgtatggggaaaaaaatgtccaagtttgtgtaaaaccagtgcatttcagcttgcaagttactgaacacaataatgctgttttaattttgttttatatcagttaaaattcacaataatgtagatagaacaaattacagacaaggaaagaaaaaacttgaatgaaatggattttacagaaagctttatgataatttttgaatgcattatttattttttgtgccatgcattttttttctcaccaaatgaccttacctgtaatacagtcttgtttgtctgtttacaaccatgtatttattgcaatgtacatactgtaatgttaattgtaaattatctgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttgcatttgattatttcctttttttttttttttaactcggaaacacaactggggaaatatattctttcccagtgattataaacaatctttttcttttttttaagtccttttggcttctagagctcataggaaaatggacttgatttgaaattggagccagagtttactcgtgttggttatctattcatcagcttcctgacatgttaagagaatacattaaagagaaaatactgttttttaatcctaaaatttttcttccactaagataaaccaaatgtccttacatatatgtaaacccatctatttaaacgcaaaggtgggttgatgtcagtttacatagcagaaagcattcactatcctctaagatttgtttctgcaaaactttcattgctttagaattttaaaatttcaccttgtacaatggccagcccctaaagcaggaaacatttataatggattatatggaaacatcctcccagtacttgcccagcccttgaatcatgtggcttttcagtgaaaggaaagattctttttctaggaaaaatgagcctattttattttattttattttattttttgacacaaactgtagattttagcagccctggcccaaaggaatttgattacttttgttttaaacagtacaaaggggacactataattacaaaaacatccttaactgatttgagttgtttttatttctttggatatattttcagagtggtaaattgtgtgtgagaattacaaatgattattcttttagtggtttcttagcctctcttacagcccacggggatagtactgtacatcaataccttcatatgaaatttttatatgcaatgaaaataaaagcatgggttgattctgcctatttatgactcaatcttttacaaataaaagattattcattttaaattatagttcaatcagcatgtctcttaggatactgaacgtggttgaaatgaaaggatagtgacatcataagttagtactgatattcataaccaaataaagccaacttgagtaattttgctacattaaaaattaccaaaattacttagatggcctataagattaagcatggtgttttctaagcaagctttgaaaggggccttccatacttacttaattgaatattctgggatattgaaaattattcagatacttgacaattatttttggttacctactccgcaaactacaaagttttaaggactcaacaataagttaatgagacacagtgtttgctttcatggagcttacagtctggaggggacaaaggcttaaacaatactcatataattatatatgtgatcagtacaatgaaggagctcagtggggtaaataagcaggaacctgaacttgatctgttccggagggccacagaaggcttccttgaggccttgagaaagtgatttgcatctgagttctgaaggattgtaagaggtaactagggaaaaagttgacaggaagaggaaggggatccagacaagaaacatttgcaaagatcttgaggcataaatgagcttgagacatctggagaaactgaggaaaagtgagagagtaggcagggcctggagccgcagagccattgctaaccatcctgtgtgagatatcccccattctgtagctttattctcataaccctgctcaattttctttataacacttctcacagatttatatacgtgtttgtttttgttatctgtctctcccaccagaccacagctccatgagagcaaggtctttgcttaccaatatatcactagcacttaaaactatgcctggtacacagtaggttcttaatatgtgttgaatatagccatcaaattgatattggatataattcaatctgataagatattttgagatattaaagagtttttaacttgataccataaaaaaaaaaaaaaaaa

SEQ ID NO: 6 - protein, 673 aa, Homo sapiens
MMHVNNFPFRRHSWICFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 7 - DNA, 8240 bp, Homo sapiens
cccctctcggtagccctgaggctctggcgccttcaagtgagaagctaagcaccagcctctgctgggctgcagaagcggcggcggcggcagcagcagcagcagcatcaggaaggcgctcgggccagcgcggtgaacccgggctgggcagcaggtcgcggagccgcgagccaggatggaggcagagggcagcagcgcgccggcccgggcgggcagcggagagggcagcgacagcgccggcggggccacgctcaaagcccccaagcatctctggaggcacgagcagcaccaccagtacccgctccggcagccccagttccgcctcctgcatccccatcaccacctgcccccgccgccgccaccctcgccccagccccagccccagtgtccgctacagccgccgccgccgccccccctgccgccgcccccgccgccgcccggggctgcccgcggccgctacgcctcgagcggggccaccggccgcgtccggcatcgcggctactcggacaccgagcgctacctgtactgtcgcgccatggaccgcacctcctacgcggtggagaccggccaccggcccggcctgaagaaatccaggatgtcctggccctcctcgttccagggactcaggcgttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgtcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatacttttatgtgtgttatatcaaatgtgtcttaagcttcatgcaaactcagtcatcagttcgtgttgtctgaagcaagtgggagatatataaatacccagtagctaaaatggtcagtcttttttagatgttttcctacttagtatctcctaataacgttttgctgtgtcactagatgttcatttcacaagtgcatgtctttctaataatccacacatttcatgctctaataatccacacatttcatgctcatttttattgtttttacagccagttatagtaagaaaaaggtttttccccttgtgctgctttataatttagcgtgtgtctgaaccttatccatgtttgctagatgaggtcttgtcaaatatatcactaccattgtcaccggtgaaaagaaacaggtagttaagttagggttaacattcatttcaaccacgaggttgtatatcatgactagcttttactcttggtttacagagaaaagttaaacagccaactaggcagtttttaagaatattaacaatatattaacaaacaccaatacaactaatcctatttggttttaatgatttcaccatgggattaagaactatatcaggaacatccctgagaaacggttttaagtgtagcaactactcttccttaatggacagccacataacgtgtaggaagtcctttatcacttatcctcgatccataagcatatcttgcagaggggaactacttctttaaacacatggagggaaagaagatgatgccactggcaccagagggttagtactgtgatgcatcctaaaatatttattatattggtaaaaattctggttaaataaaaaattagagatcactcttggctgatttcagcaccaggaactgtattacagttttagagattaattcctagtgtttacctgattatagcagttggcatcatggggcatttaattctgactttatccccacgtcagccttaataaagtcttctttaccttctctatgaagactttaaagcccaaataatcatttttcacattgatattcaagaattgagatagatagaagccaaagtgggtatctgacaagtggaaaatcaaacgtttaagaagaattacaactctgaaaagcatttatatgtggaacttctcaaggagcctcctggggactggaaagtaagtcatcagccaggcaaatgactcatgctgaagagagtccccatttcagtcccctgagatctagctgatgcttagatcctttgaaataaaaattatgtctttataactctgatcttttacataaagcagaagaggaatcaactagttaattgcaaggtttctactctgtttcctctgtaaagatcagatggtaatctttcaaataagaaaaaaataaagacgtatgtttgaccaagtagtttcacaagaatatttgggaacttgtttcttttaattttatttgtccctgagtgaagtctagaaagaaaggtaaagagtctagagtttattcctctttccaaaacattctcattcctctcctccctacacttagtatttcccccacagagtgcctagaatcttaataatgaataaaataaaaagcagcaatatgtcattaacaaatccagacctgaaagggtaaagggtttataactgcactaataaagagaggctctttttttttcttccagtttgttggtttttaatggtaccgtgttgtaaagatacccactaatggacaatcaaattgcagaaaaggctcaatatccaagagacagggactaatgcactgtacaatctgcttatccttgcccttctctcttgccaaagtgtgcttcagaaatatatactgctttaaaaaagaataaaagaatatccttttacaagtggctttacatttcctaaaatgccataagaaaatgcaatatctgggtactgtatggggaaaaaaatgtccaagtttgtgtaaaaccagtgcatttcagcttgcaagttactgaacacaataatgctgttttaattttgttttatatcagttaaaattcacaataatgtagatagaacaaattacagacaaggaaagaaaaaacttgaatgaaatggattttacagaaagctttatgataatttttgaatgcattatttattttttgtgccatgcattttttttctcaccaaatgaccttacctgtaatacagtcttgtttgtctgtttacaaccatgtatttattgcaatgtacatactgtaatgttaattgtaaattatctgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttgcatttgattatttcctttttttttttttttaactcggaaacacaactggggaaatatattctttcccagtgattataaacaatctttttcttttttttaagtccttttggcttctagagctcataggaaaatggacttgatttgaaattggagccagagtttactcgtgttggttatctattcatcagcttcctgacatgttaagagaatacattaaagagaaaatactgttttttaatcctaaaatttttcttccactaagataaaccaaatgtccttacatatatgtaaacccatctatttaaacgcaaaggtgggttgatgtcagtttacatagcagaaagcattcactatcctctaagatttgtttctgcaaaactttcattgctttagaattttaaaatttcaccttgtacaatggccagcccctaaagcaggaaacatttataatggattatatggaaacatcctcccagtacttgcccagcccttgaatcatgtggcttttcagtgaaaggaaagattctttttctaggaaaaatgagcctattttattttattttattttattttttgacacaaactgtagattttagcagccctggcccaaaggaatttgattacttttgttttaaacagtacaaaggggacactataattacaaaaacatccttaactgatttgagttgtttttatttctttggatatattttcagagtggtaaattgtgtgtgagaattacaaatgattattcttttagtggtttcttagcctctcttacagcccacggggatagtactgtacatcaataccttcatatgaaatttttatatgcaatgaaaataaaagcatgggttgattctgcctatttatgactcaatcttttacaaataaaagattattcattttaaattatagttcaatcagcatgtctcttaggatactgaacgtggttgaaatgaaaggatagtgacatcataagttagtactgatattcataaccaaataaagccaacttgagtaattttgctacattaaaaattaccaaaattacttagatggcctataagattaagcatggtgttttctaagcaagctttgaaaggggccttccatacttacttaattgaatattctgggatattgaaaattattcagatacttgacaattatttttggttacctactccgcaaactacaaagttttaaggactcaacaataagttaatgagacacagtgtttgctttcatggagcttacagtctggaggggacaaaggcttaaacaatactcatataattatatatgtgatcagtacaatgaaggagctcagtggggtaaataagcaggaacctgaacttgatctgttccggagggccacagaaggcttccttgaggccttgagaaagtgatttgcatctgagttctgaaggattgtaagaggtaactagggaaaaagttgacaggaagaggaaggggatccagacaagaaacatttgcaaagatcttgaggcataaatgagcttgagacatctggagaaactgaggaaaagtgagagagtaggcagggcctggagccgcagagccattgctaaccatcctgtgtgagatatcccccattctgtagctttattctcataaccctgctcaattttctttataacacttctcacagatttatatacgtgtttgtttttgttatctgtctctcccaccagaccacagctccatgagagcaaggtctttgcttaccaatatatcactagcacttaaaactatgcctggtacacagtaggttcttaatatgtgttgaatatagccatcaaattgatattggatataattcaatctgataagatattttgagatattaaagagtttttaacttgataccataaaaaaaaaaaaaaaaa

SEQ ID NO: 8 - protein, 809 aa, Homo sapiens
MEAEGSSAPARAGSGEGSDSAGGATLKAPKHLWRHEQHHQYPLRQPQFRLLHPHHHLPPPPPPSPQPQPQCPLQPPPPPPLPPPPPPPGAARGRYASSGATGRVRHRGYSDTERYLYCRAMDRTSYAVETGHRPGLKKSRMSWPSSFQGLRRFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 9 - DNA, 7979 bp, Homo sapiens
cagcagcaggctcagacctgcttccctggacatttccgggaccgtgagcgagggaaccacgttgccctggattcttgccagctgtacaaagttgaccaggaaaatggctcagcagacaagcccggacactttaacagtacctgaagtggataatccgcattgtccaaacccgtggctgaacgaagaccttgtgaaatccttgcgagaaaacctgttgcagcatgagaagtccaagacagcgaggaaatcggtttctcccaagctctctccagtgatctctccgagaaattcccccaggcttctgcgcagaatgcttctcagcagcaacatccccaaacagcggcgtttcacggtggcacatacatgttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgtcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatacttttatgtgtgttatatcaaatgtgtcttaagcttcatgcaaactcagtcatcagttcgtgttgtctgaagcaagtgggagatatataaatacccagtagctaaaatggtcagtcttttttagatgttttcctacttagtatctcctaataacgttttgctgtgtcactagatgttcatttcacaagtgcatgtctttctaataatccacacatttcatgctctaataatccacacatttcatgctcatttttattgtttttacagccagttatagtaagaaaaaggtttttccccttgtgctgctttataatttagcgtgtgtctgaaccttatccatgtttgctagatgaggtcttgtcaaatatatcactaccattgtcaccggtgaaaagaaacaggtagttaagttagggttaacattcatttcaaccacgaggttgtatatcatgactagcttttactcttggtttacagagaaaagttaaacagccaactaggcagtttttaagaatattaacaatatattaacaaacaccaatacaactaatcctatttggttttaatgatttcaccatgggattaagaactatatcaggaacatccctgagaaacggttttaagtgtagcaactactcttccttaatggacagccacataacgtgtaggaagtcctttatcacttatcctcgatccataagcatatcttgcagaggggaactacttctttaaacacatggagggaaagaagatgatgccactggcaccagagggttagtactgtgatgcatcctaaaatatttattatattggtaaaaattctggttaaataaaaaattagagatcactcttggctgatttcagcaccaggaactgtattacagttttagagattaattcctagtgtttacctgattatagcagttggcatcatggggcatttaattctgactttatccccacgtcagccttaataaagtcttctttaccttctctatgaagactttaaagcccaaataatcatttttcacattgatattcaagaattgagatagatagaagccaaagtgggtatctgacaagtggaaaatcaaacgtttaagaagaattacaactctgaaaagcatttatatgtggaacttctcaaggagcctcctggggactggaaagtaagtcatcagccaggcaaatgactcatgctgaagagagtccccatttcagtcccctgagatctagctgatgcttagatcctttgaaataaaaattatgtctttataactctgatcttttacataaagcagaagaggaatcaactagttaattgcaaggtttctactctgtttcctctgtaaagatcagatggtaatctttcaaataagaaaaaaataaagacgtatgtttgaccaagtagtttcacaagaatatttgggaacttgtttcttttaattttatttgtccctgagtgaagtctagaaagaaaggtaaagagtctagagtttattcctctttccaaaacattctcattcctctcctccctacacttagtatttcccccacagagtgcctagaatcttaataatgaataaaataaaaagcagcaatatgtcattaacaaatccagacctgaaagggtaaagggtttataactgcactaataaagagaggctctttttttttcttccagtttgttggtttttaatggtaccgtgttgtaaagatacccactaatggacaatcaaattgcagaaaaggctcaatatccaagagacagggactaatgcactgtacaatctgcttatccttgcccttctctcttgccaaagtgtgcttcagaaatatatactgctttaaaaaagaataaaagaatatccttttacaagtggctttacatttcctaaaatgccataagaaaatgcaatatctgggtactgtatggggaaaaaaatgtccaagtttgtgtaaaaccagtgcatttcagcttgcaagttactgaacacaataatgctgttttaattttgttttatatcagttaaaattcacaataatgtagatagaacaaattacagacaaggaaagaaaaaacttgaatgaaatggattttacagaaagctttatgataatttttgaatgcattatttattttttgtgccatgcattttttttctcaccaaatgaccttacctgtaatacagtcttgtttgtctgtttacaaccatgtatttattgcaatgtacatactgtaatgttaattgtaaattatctgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttgcatttgattatttcctttttttttttttttaactcggaaacacaactggggaaatatattctttcccagtgattataaacaatctttttcttttttttaagtccttttggcttctagagctcataggaaaatggacttgatttgaaattggagccagagtttactcgtgttggttatctattcatcagcttcctgacatgttaagagaatacattaaagagaaaatactgttttttaatcctaaaatttttcttccactaagataaaccaaatgtccttacatatatgtaaacccatctatttaaacgcaaaggtgggttgatgtcagtttacatagcagaaagcattcactatcctctaagatttgtttctgcaaaactttcattgctttagaattttaaaatttcaccttgtacaatggccagcccctaaagcaggaaacatttataatggattatatggaaacatcctcccagtacttgcccagcccttgaatcatgtggcttttcagtgaaaggaaagattctttttctaggaaaaatgagcctattttattttattttattttattttttgacacaaactgtagattttagcagccctggcccaaaggaatttgattacttttgttttaaacagtacaaaggggacactataattacaaaaacatccttaactgatttgagttgtttttatttctttggatatattttcagagtggtaaattgtgtgtgagaattacaaatgattattcttttagtggtttcttagcctctcttacagcccacggggatagtactgtacatcaataccttcatatgaaatttttatatgcaatgaaaataaaagcatgggttgattctgcctatttatgactcaatcttttacaaataaaagattattcattttaaattatagttcaatcagcatgtctcttaggatactgaacgtggttgaaatgaaaggatagtgacatcataagttagtactgatattcataaccaaataaagccaacttgagtaattttgctacattaaaaattaccaaaattacttagatggcctataagattaagcatggtgttttctaagcaagctttgaaaggggccttccatacttacttaattgaatattctgggatattgaaaattattcagatacttgacaattatttttggttacctactccgcaaactacaaagttttaaggactcaacaataagttaatgagacacagtgtttgctttcatggagcttacagtctggaggggacaaaggcttaaacaatactcatataattatatatgtgatcagtacaatgaaggagctcagtggggtaaataagcaggaacctgaacttgatctgttccggagggccacagaaggcttccttgaggccttgagaaagtgatttgcatctgagttctgaaggattgtaagaggtaactagggaaaaagttgacaggaagaggaaggggatccagacaagaaacatttgcaaagatcttgaggcataaatgagcttgagacatctggagaaactgaggaaaagtgagagagtaggcagggcctggagccgcagagccattgctaaccatcctgtgtgagatatcccccattctgtagctttattctcataaccctgctcaattttctttataacacttctcacagatttatatacgtgtttgtttttgttatctgtctctcccaccagaccacagctccatgagagcaaggtctttgcttaccaatatatcactagcacttaaaactatgcctggtacacagtaggttcttaatatgtgttgaatatagccatcaaattgatattggatataattcaatctgataagatattttgagatattaaagagtttttaacttgataccataaaaaaaaaaaaaaaaa

SEQ ID NO: 10 - protein, 745 aa, Homo sapiens
MAQQTSPDTLTVPEVDNPHCPNPWLNEDLVKSLRENLLQHEKSKTARKSVSPKLSPVISPRNSPRLLRRMLLSSNIPKQRRFTVAHTCFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 11 - DNA, 7591 bp, Homo sapiens
agttccttatttggtagcttttgacaggactagcctttcttgcaactaagcatcttgacatacattattcattaagccctggagctcgggagagaaagatgcagacccttagatctttagatattcctttatcacgtggattttctttattcagaatagttgctgaattttgtgccattctggagtcttacaaatggcatgtattcgatgggaagacggctggatgggatttaatgcgaggctttcttatgtatacttaattaccaaaaatctttaaaaactcatactctgcgtggcttgtggaggttgttaaagtgtcgagattttgaagctaaatacattttagagcttactatatatatacatatatatatatatacatataatcaatcaaaaatgcctgaagcaaactatttactgtcagtgtcttggggctacataaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgtcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatacttttatgtgtgttatatcaaatgtgtcttaagcttcatgcaaactcagtcatcagttcgtgttgtctgaagcaagtgggagatatataaatacccagtagctaaaatggtcagtcttttttagatgttttcctacttagtatctcctaataacgttttgctgtgtcactagatgttcatttcacaagtgcatgtctttctaataatccacacatttcatgctctaataatccacacatttcatgctcatttttattgtttttacagccagttatagtaagaaaaaggtttttccccttgtgctgctttataatttagcgtgtgtctgaaccttatccatgtttgctagatgaggtcttgtcaaatatatcactaccattgtcaccggtgaaaagaaacaggtagttaagttagggttaacattcatttcaaccacgaggttgtatatcatgactagcttttactcttggtttacagagaaaagttaaacagccaactaggcagtttttaagaatattaacaatatattaacaaacaccaatacaactaatcctatttggttttaatgatttcaccatgggattaagaactatatcaggaacatccctgagaaacggttttaagtgtagcaactactcttccttaatggacagccacataacgtgtaggaagtcctttatcacttatcctcgatccataagcatatcttgcagaggggaactacttctttaaacacatggagggaaagaagatgatgccactggcaccagagggttagtactgtgatgcatcctaaaatatttattatattggtaaaaattctggttaaataaaaaattagagatcactcttggctgatttcagcaccaggaactgtattacagttttagagattaattcctagtgtttacctgattatagcagttggcatcatggggcatttaattctgactttatccccacgtcagccttaataaagtcttctttaccttctctatgaagactttaaagcccaaataatcatttttcacattgatattcaagaattgagatagatagaagccaaagtgggtatctgacaagtggaaaatcaaacgtttaagaagaattacaactctgaaaagcatttatatgtggaacttctcaaggagcctcctggggactggaaagtaagtcatcagccaggcaaatgactcatgctgaagagagtccccatttcagtcccctgagatctagctgatgcttagatcctttgaaataaaaattatgtctttataactctgatcttttacataaagcagaagaggaatcaactagttaattgcaaggtttctactctgtttcctctgtaaagatcagatggtaatctttcaaataagaaaaaaataaagacgtatgtttgaccaagtagtttcacaagaatatttgggaacttgtttcttttaattttatttgtccctgagtgaagtctagaaagaaaggtaaagagtctagagtttattcctctttccaaaacattctcattcctctcctccctacacttagtatttcccccacagagtgcctagaatcttaataatgaataaaataaaaagcagcaatatgtcattaacaaatccagacctgaaagggtaaagggtttataactgcactaataaagagaggctctttttttttcttccagtttgttggtttttaatggtaccgtgttgtaaagatacccactaatggacaatcaaattgcagaaaaggctcaatatccaagagacagggactaatgcactgtacaatctgcttatccttgcccttctctcttgccaaagtgtgcttcagaaatatatactgctttaaaaaagaataaaagaatatccttttacaagtggctttacatttcctaaaatgccataagaaaatgcaatatctgggtactgtatggggaaaaaaatgtccaagtttgtgtaaaaccagtgcatttcagcttgcaagttactgaacacaataatgctgttttaattttgttttatatcagttaaaattcacaataatgtagatagaacaaattacagacaaggaaagaaaaaacttgaatgaaatggattttacagaaagctttatgataatttttgaatgcattatttattttttgtgccatgcattttttttctcaccaaatgaccttacctgtaatacagtcttgtttgtctgtttacaaccatgtatttattgcaatgtacatactgtaatgttaattgtaaattatctgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttgcatttgattatttcctttttttttttttttaactcggaaacacaactggggaaatatattctttcccagtgattataaacaatctttttcttttttttaagtccttttggcttctagagctcataggaaaatggacttgatttgaaattggagccagagtttactcgtgttggttatctattcatcagcttcctgacatgttaagagaatacattaaagagaaaatactgttttttaatcctaaaatttttcttccactaagataaaccaaatgtccttacatatatgtaaacccatctatttaaacgcaaaggtgggttgatgtcagtttacatagcagaaagcattcactatcctctaagatttgtttctgcaaaactttcattgctttagaattttaaaatttcaccttgtacaatggccagcccctaaagcaggaaacatttataatggattatatggaaacatcctcccagtacttgcccagcccttgaatcatgtggcttttcagtgaaaggaaagattctttttctaggaaaaatgagcctattttattttattttattttattttttgacacaaactgtagattttagcagccctggcccaaaggaatttgattacttttgttttaaacagtacaaaggggacactataattacaaaaacatccttaactgatttgagttgtttttatttctttggatatattttcagagtggtaaattgtgtgtgagaattacaaatgattattcttttagtggtttcttagcctctcttacagcccacggggatagtactgtacatcaataccttcatatgaaatttttatatgcaatgaaaataaaagcatgggttgattctgcctatttatgactcaatcttttacaaataaaagattattcattttaaattatagttcaatcagcatgtctcttaggatactgaacgtggttgaaatgaaaggatagtgacatcataagttagtactgatattcataaccaaataaagccaacttgagtaattttgctacattaaaaattaccaaaattacttagatggcctataagattaagcatggtgttttctaagcaagctttgaaaggggccttccatacttacttaattgaatattctgggatattgaaaattattcagatacttgacaattatttttggttacctactccgcaaactacaaagttttaaggactcaacaataagttaatgagacacagtgtttgctttcatggagcttacagtctggaggggacaaaggcttaaacaatactcatataattatatatgtgatcagtacaatgaaggagctcagtggggtaaataagcaggaacctgaacttgatctgttccggagggccacagaaggcttccttgaggccttgagaaagtgatttgcatctgagttctgaaggattgtaagaggtaactagggaaaaagttgacaggaagaggaaggggatccagacaagaaacatttgcaaagatcttgaggcataaatgagcttgagacatctggagaaactgaggaaaagtgagagagtaggcagggcctggagccgcagagccattgctaaccatcctgtgtgagatatcccccattctgtagctttattctcataaccctgctcaattttctttataacacttctcacagatttatatacgtgtttgtttttgttatctgtctctcccaccagaccacagctccatgagagcaaggtctttgcttaccaatatatcactagcacttaaaactatgcctggtacacagtaggttcttaatatgtgttgaatatagccatcaaattgatattggatataattcaatctgataagatattttgagatattaaagagtttttaacttgataccataaaaaaaaaaaaaaaaa

SEQ ID NO: 12 - protein, 518 aa, Homo sapiens
MPEANYLLSVSWGYIKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 13 - DNA, 8130 bp, Homo sapiens
agattatagcccagcgtacgagaagcacgagtcctatagttggcgtaccctgaggcctgccagttcctgccttaatgcatatgtagtcgtaattgagttctgacacggccttggatgtttctgtcctaaatagctgacattgcatcttcaagactgtcattccagttggcttttgagtggatacgtgcagtgagatcattgacactggaaacactagttcccattttaattacttaaaacaccacgatgaaaagaaatacctgtgatttgctttctcggagcaaaagtgcctctgaggaaacactacattccagtaatgaagaggaagaccctttccgcggaatggaaccctatcttgtccggagactttcatgtcgcaatattcagcttccccctctcgccttcagacagttggaacaagctgacttgaaaagtgaatcagagaacattcaacgaccaaccagcctccccctgaagattctgccgctgattgctatcacttctgcagaatccagtggttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgtcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatacttttatgtgtgttatatcaaatgtgtcttaagcttcatgcaaactcagtcatcagttcgtgttgtctgaagcaagtgggagatatataaatacccagtagctaaaatggtcagtcttttttagatgttttcctacttagtatctcctaataacgttttgctgtgtcactagatgttcatttcacaagtgcatgtctttctaataatccacacatttcatgctctaataatccacacatttcatgctcatttttattgtttttacagccagttatagtaagaaaaaggtttttccccttgtgctgctttataatttagcgtgtgtctgaaccttatccatgtttgctagatgaggtcttgtcaaatatatcactaccattgtcaccggtgaaaagaaacaggtagttaagttagggttaacattcatttcaaccacgaggttgtatatcatgactagcttttactcttggtttacagagaaaagttaaacagccaactaggcagtttttaagaatattaacaatatattaacaaacaccaatacaactaatcctatttggttttaatgatttcaccatgggattaagaactatatcaggaacatccctgagaaacggttttaagtgtagcaactactcttccttaatggacagccacataacgtgtaggaagtcctttatcacttatcctcgatccataagcatatcttgcagaggggaactacttctttaaacacatggagggaaagaagatgatgccactggcaccagagggttagtactgtgatgcatcctaaaatatttattatattggtaaaaattctggttaaataaaaaattagagatcactcttggctgatttcagcaccaggaactgtattacagttttagagattaattcctagtgtttacctgattatagcagttggcatcatggggcatttaattctgactttatccccacgtcagccttaataaagtcttctttaccttctctatgaagactttaaagcccaaataatcatttttcacattgatattcaagaattgagatagatagaagccaaagtgggtatctgacaagtggaaaatcaaacgtttaagaagaattacaactctgaaaagcatttatatgtggaacttctcaaggagcctcctggggactggaaagtaagtcatcagccaggcaaatgactcatgctgaagagagtccccatttcagtcccctgagatctagctgatgcttagatcctttgaaataaaaattatgtctttataactctgatcttttacataaagcagaagaggaatcaactagttaattgcaaggtttctactctgtttcctctgtaaagatcagatggtaatctttcaaataagaaaaaaataaagacgtatgtttgaccaagtagtttcacaagaatatttgggaacttgtttcttttaattttatttgtccctgagtgaagtctagaaagaaaggtaaagagtctagagtttattcctctttccaaaacattctcattcctctcctccctacacttagtatttcccccacagagtgcctagaatcttaataatgaataaaataaaaagcagcaatatgtcattaacaaatccagacctgaaagggtaaagggtttataactgcactaataaagagaggctctttttttttcttccagtttgttggtttttaatggtaccgtgttgtaaagatacccactaatggacaatcaaattgcagaaaaggctcaatatccaagagacagggactaatgcactgtacaatctgcttatccttgcccttctctcttgccaaagtgtgcttcagaaatatatactgctttaaaaaagaataaaagaatatccttttacaagtggctttacatttcctaaaatgccataagaaaatgcaatatctgggtactgtatggggaaaaaaatgtccaagtttgtgtaaaaccagtgcatttcagcttgcaagttactgaacacaataatgctgttttaattttgttttatatcagttaaaattcacaataatgtagatagaacaaattacagacaaggaaagaaaaaacttgaatgaaatggattttacagaaagctttatgataatttttgaatgcattatttattttttgtgccatgcattttttttctcaccaaatgaccttacctgtaatacagtcttgtttgtctgtttacaaccatgtatttattgcaatgtacatactgtaatgttaattgtaaattatctgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttgcatttgattatttcctttttttttttttttaactcggaaacacaactggggaaatatattctttcccagtgattataaacaatctttttcttttttttaagtccttttggcttctagagctcataggaaaatggacttgatttgaaattggagccagagtttactcgtgttggttatctattcatcagcttcctgacatgttaagagaatacattaaagagaaaatactgttttttaatcctaaaatttttcttccactaagataaaccaaatgtccttacatatatgtaaacccatctatttaaacgcaaaggtgggttgatgtcagtttacatagcagaaagcattcactatcctctaagatttgtttctgcaaaactttcattgctttagaattttaaaatttcaccttgtacaatggccagcccctaaagcaggaaacatttataatggattatatggaaacatcctcccagtacttgcccagcccttgaatcatgtggcttttcagtgaaaggaaagattctttttctaggaaaaatgagcctattttattttattttattttattttttgacacaaactgtagattttagcagccctggcccaaaggaatttgattacttttgttttaaacagtacaaaggggacactataattacaaaaacatccttaactgatttgagttgtttttatttctttggatatattttcagagtggtaaattgtgtgtgagaattacaaatgattattcttttagtggtttcttagcctctcttacagcccacggggatagtactgtacatcaataccttcatatgaaatttttatatgcaatgaaaataaaagcatgggttgattctgcctatttatgactcaatcttttacaaataaaagattattcattttaaattatagttcaatcagcatgtctcttaggatactgaacgtggttgaaatgaaaggatagtgacatcataagttagtactgatattcataaccaaataaagccaacttgagtaattttgctacattaaaaattaccaaaattacttagatggcctataagattaagcatggtgttttctaagcaagctttgaaaggggccttccatacttacttaattgaatattctgggatattgaaaattattcagatacttgacaattatttttggttacctactccgcaaactacaaagttttaaggactcaacaataagttaatgagacacagtgtttgctttcatggagcttacagtctggaggggacaaaggcttaaacaatactcatataattatatatgtgatcagtacaatgaaggagctcagtggggtaaataagcaggaacctgaacttgatctgttccggagggccacagaaggcttccttgaggccttgagaaagtgatttgcatctgagttctgaaggattgtaagaggtaactagggaaaaagttgacaggaagaggaaggggatccagacaagaaacatttgcaaagatcttgaggcataaatgagcttgagacatctggagaaactgaggaaaagtgagagagtaggcagggcctggagccgcagagccattgctaaccatcctgtgtgagatatcccccattctgtagctttattctcataaccctgctcaattttctttataacacttctcacagatttatatacgtgtttgtttttgttatctgtctctcccaccagaccacagctccatgagagcaaggtctttgcttaccaatatatcactagcacttaaaactatgcctggtacacagtaggttcttaatatgtgttgaatatagccatcaaattgatattggatataattcaatctgataagatattttgagatattaaagagtttttaacttgataccataaaaaaaaaaaaaaaa

SEQ ID NO: 14 - protein, 748 aa, Homo sapiens
MKRNTCDLLSRSKSASEETLHSSNEEEDPFRGMEPYLVRRLSCRNIQLPPLAFRQLEQADLKSESENIQRPTSLPLKILPLIAITSAESSGFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 15 - DNA, 8130 bp, Homo sapiens; identical to SEQ ID NO: 13

SEQ ID NO: 16 - protein, 687 aa, Homo sapiens
MAFVWDPLGATVPGPSTRAKSRLRFSKSYSFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 17 - DNA, 8395 bp, Homo sapiens
ttctcactgccctgcggtgttttgaactgccttcttacagacgtcatacagcccttgaggaatagtttctgcctggtgagattgaatgatagttctcattcacaaaaccctggattctaagcagggacacacagaaattactttcgcaggtaaatcagcccacccagccaaagtgtggagagatttgttccttggctgacttctttgctccacggagaggagtgttttcctgtgcttgccctgaaatggaacttccttgacagctctcccgtgttacagtacctcccggtcattttctttttctctctctctacctgcgctcttcgagtgtcagaaacctttaaagctgttactatggaattgcaaaaaagagatcaagtgactctttcactatgctggtttcccttgtgacccagatgaagaatcaattcagaattcagttcctcccttggcattgcaagacacagaagaaactgtcacttcctaacagcctagtactggagtaaattcagtatgaaggaagaaagcgctcctgcgtgttagaaccttgcccatgagctggaccgaggacaggagatggactccaggaaaattggatttcttcaagcagcctcccttggaaatggaatatctttaaaatcttctttgcagaaagacagttagaatgtattaatcagaatagttgaagacttattttcctttttattttttttcaaaatgagcattattatgaagccaagatcccgatctacaagttccctaaggactgcagaggcagtttgttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgtcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatacttttatgtgtgttatatcaaatgtgtcttaagcttcatgcaaactcagtcatcagttcgtgttgtctgaagcaagtgggagatatataaatacccagtagctaaaatggtcagtcttttttagatgttttcctacttagtatctcctaataacgttttgctgtgtcactagatgttcatttcacaagtgcatgtctttctaataatccacacatttcatgctctaataatccacacatttcatgctcatttttattgtttttacagccagttatagtaagaaaaaggtttttccccttgtgctgctttataatttagcgtgtgtctgaaccttatccatgtttgctagatgaggtcttgtcaaatatatcactaccattgtcaccggtgaaaagaaacaggtagttaagttagggttaacattcatttcaaccacgaggttgtatatcatgactagcttttactcttggtttacagagaaaagttaaacagccaactaggcagtttttaagaatattaacaatatattaacaaacaccaatacaactaatcctatttggttttaatgatttcaccatgggattaagaactatatcaggaacatccctgagaaacggttttaagtgtagcaactactcttccttaatggacagccacataacgtgtaggaagtcctttatcacttatcctcgatccataagcatatcttgcagaggggaactacttctttaaacacatggagggaaagaagatgatgccactggcaccagagggttagtactgtgatgcatcctaaaatatttattatattggtaaaaattctggttaaataaaaaattagagatcactcttggctgatttcagcaccaggaactgtattacagttttagagattaattcctagtgtttacctgattatagcagttggcatcatggggcatttaattctgactttatccccacgtcagccttaataaagtcttctttaccttctctatgaagactttaaagcccaaataatcatttttcacattgatattcaagaattgagatagatagaagccaaagtgggtatctgacaagtggaaaatcaaacgtttaagaagaattacaactctgaaaagcatttatatgtggaacttctcaaggagcctcctggggactggaaagtaagtcatcagccaggcaaatgactcatgctgaagagagtccccatttcagtcccctgagatctagctgatgcttagatcctttgaaataaaaattatgtctttataactctgatcttttacataaagcagaagaggaatcaactagttaattgcaaggtttctactctgtttcctctgtaaagatcagatggtaatctttcaaataagaaaaaaataaagacgtatgtttgaccaagtagtttcacaagaatatttgggaacttgtttcttttaattttatttgtccctgagtgaagtctagaaagaaaggtaaagagtctagagtttattcctctttccaaaacattctcattcctctcctccctacacttagtatttcccccacagagtgcctagaatcttaataatgaataaaataaaaagcagcaatatgtcattaacaaatccagacctgaaagggtaaagggtttataactgcactaataaagagaggctctttttttttcttccagtttgttggtttttaatggtaccgtgttgtaaagatacccactaatggacaatcaaattgcagaaaaggctcaatatccaagagacagggactaatgcactgtacaatctgcttatccttgcccttctctcttgccaaagtgtgcttcagaaatatatactgctttaaaaaagaataaaagaatatccttttacaagtggctttacatttcctaaaatgccataagaaaatgcaatatctgggtactgtatggggaaaaaaatgtccaagtttgtgtaaaaccagtgcatttcagcttgcaagttactgaacacaataatgctgttttaattttgttttatatcagttaaaattcacaataatgtagatagaacaaattacagacaaggaaagaaaaaacttgaatgaaatggattttacagaaagctttatgataatttttgaatgcattatttattttttgtgccatgcattttttttctcaccaaatgaccttacctgtaatacagtcttgtttgtctgtttacaaccatgtatttattgcaatgtacatactgtaatgttaattgtaaattatctgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttgcatttgattatttcctttttttttttttttaactcggaaacacaactggggaaatatattctttcccagtgattataaacaatctttttcttttttttaagtccttttggcttctagagctcataggaaaatggacttgatttgaaattggagccagagtttactcgtgttggttatctattcatcagcttcctgacatgttaagagaatacattaaagagaaaatactgttttttaatcctaaaatttttcttccactaagataaaccaaatgtccttacatatatgtaaacccatctatttaaacgcaaaggtgggttgatgtcagtttacatagcagaaagcattcactatcctctaagatttgtttctgcaaaactttcattgctttagaattttaaaatttcaccttgtacaatggccagcccctaaagcaggaaacatttataatggattatatggaaacatcctcccagtacttgcccagcccttgaatcatgtggcttttcagtgaaaggaaagattctttttctaggaaaaatgagcctattttattttattttattttattttttgacacaaactgtagattttagcagccctggcccaaaggaatttgattacttttgttttaaacagtacaaaggggacactataattacaaaaacatccttaactgatttgagttgtttttatttctttggatatattttcagagtggtaaattgtgtgtgagaattacaaatgattattcttttagtggtttcttagcctctcttacagcccacggggatagtactgtacatcaataccttcatatgaaatttttatatgcaatgaaaataaaagcatgggttgattctgcctatttatgactcaatcttttacaaataaaagattattcattttaaattatagttcaatcagcatgtctcttaggatactgaacgtggttgaaatgaaaggatagtgacatcataagttagtactgatattcataaccaaataaagccaacttgagtaattttgctacattaaaaattaccaaaattacttagatggcctataagattaagcatggtgttttctaagcaagctttgaaaggggccttccatacttacttaattgaatattctgggatattgaaaattattcagatacttgacaattatttttggttacctactccgcaaactacaaagttttaaggactcaacaataagttaatgagacacagtgtttgctttcatggagcttacagtctggaggggacaaaggcttaaacaatactcatataattatatatgtgatcagtacaatgaaggagctcagtggggtaaataagcaggaacctgaacttgatctgttccggagggccacagaaggcttccttgaggccttgagaaagtgatttgcatctgagttctgaaggattgtaagaggtaactagggaaaaagttgacaggaagaggaaggggatccagacaagaaacatttgcaaagatcttgaggcataaatgagcttgagacatctggagaaactgaggaaaagtgagagagtaggcagggcctggagccgcagagccattgctaaccatcctgtgtgagatatcccccattctgtagctttattctcataaccctgctcaattttctttataacacttctcacagatttatatacgtgtttgtttttgttatctgtctctcccaccagaccacagctccatgagagcaaggtctttgcttaccaatatatcactagcacttaaaactatgcctggtacacagtaggttcttaatatgtgttgaatatagccatcaaattgatattggatataattcaatctgataagatattttgagatattaaagagtttttaacttgataccataaaaaaaaaaaaaaaaa

SEQ ID NO: 18 - protein, 679 aa, Homo sapiens
MSIIMKPRSRSTSSLRTAEAVCFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 19 - DNA, 1020873 bp, Homo sapiens
tatctttcctatgtttagatatacttagatacacaaatatttcccattgtgttataattgcctacagtatttattacagtaacaatgtaccatctaggtttgtttaaatacactgtgatgttcacacaaggaaatttcctaatgatgcatttctcagaatggatcattatcaagtgatgcataactgtatgtgtgtgtgtgtatatatatatatatatatatatatatatgacacatgcatatgtcaatgtatatatttaatgatgtttgcaattcatttcatagaagttataaaaacattttgatttatccttgattttatagaattcacacacaaagctaataaattctaagattactgaagatgttagttaactgttttaaccaagccacacctggtgaacaaatttgctattttaaaaataaatttagattttagttaatcaaatattgttcagttaatgtcactgttttctagatagcatttttcatgtatacattttacttaatttctttcccaggaaagtattaagccattatgtaatgataaacagtgtgatttttgttgattatatgtactttcttgaattattacctcaggcctctgaggaaacactacattccagtaatgaagaggaagaccctttccgcggaatggaaccctatcttgtccggagactttcatgtcgcaatattcagcttccccctctcgccttcagacagttggaacaagctgacttgaaaagtgaatcagagaacattcaacgaccaaccagcctccccctgaagattctgccgctgattgctatcacttctgcagaatccagtgggtgagtgccctcagatgtcatttccccattttatattttagatggtgattgttgtctgtggtcttttgagtttttgtggctcattgcttgatttgagtgggagaacaatggggtttctagagtcaaaaaaaaaaggatgaatttctcaggtgacatttctatatctgcaggagaagacattttagtgaaattgttttacatggaagagctgaaaatgtattggtgaatgctaataaacatttgccaaagggcagttgtacttggaaaattaatattggccatatgtgacttgatagaagacattttaacaaatgagaactaatggacaaattaccatgtagtgatacatgtctagaaacaataggaaatgttcactgatgcaaaatgaatttggaatcaagaataaattgtattgtaattagaatcaaaagaaatatgcaatggtattcatgagtctaaaaattttgcctttgacattttgaggtattgcttaccagaatactatttcagctcccagtataaggtgattttatttagcattagtacttatagaggagtcagccacagccacgtctccatcatgtaacatttttatttcctactttgcagggtataatttttgtttttattctttttcgtgttgtttaccaatggagttttacactttaaagcaatgtcaccagtttaaaaattgtgaaagaaagtaaggatattgggcacatcaattatttgttcttgtgaccagctgcatttttaagaagcctggatagaaaggaaagaggatgaagccagtgggccatacatagatagactcttgaacatttgctaaaactacaagaacaaaacaattactatgctacaaatgtgatggtcccacattctctgccaagttaaaggcatctctggggaaaatgtcttttggatcttgttaaagttaggaaggttgtgctcagaggaaatttggctagtaactcaactcaaagatactgaatttagctgttttacttgttattgaccagtctaagggacctgtgttagaaaaaggtatgaggaaaatactactagataaataataagaaaacaaatattcaccttgaagcaatgaaaagaggaaatatattttgtttctgttgttgtaattgaactatgtgtttaaagaagaatgcacacacattgatcagactcatactaaagcagatgggaattttatatgacagcttgacctgaacattttttgaaaaatgctgttcccctgaaactatttctcctttctttggaaataacattgctgccgttcattctgtgtagaagagattcacagatatcaggtgtatccagggatcccaagatcaccctcgggttcaatgatttgctagcagagctctcataattcagcaaatagtcatattcatggctctgatgtgttatagcaaaaggattcaatgcaaaataagcaaagggaaaggtagatggaacaaaatctggaggaaaccaaacataagcttccaagagtccccaagtgaagtaagacaagatacacttaattcctccagtaatgagttgagacaacacttgtgaaatgtgttcaccagggatgcctttaccagggaagcctattaaagactcagtacctagagtttttactggaggccagtcacttaggtaccctctgcctaggatatacaaacttccagatttccagaaggaaagtggatatgcagcataaaccacattatttgcacagacagtttaggcaaattgagccagtcttaccatttagagaatggtggatcactcctgaaagtcaggtctgctaaaggccaatgtttcaaacaggtcttcctatatttaattgacacagtcctgattaactgtttactacacaccaggttatcttagaatagttatcttactttcttcacacttgtggaagaagagattataattaaaattaaaatgcactaatttaaagccctgatatattcaattagctttggtatctcaaaaattttggttgctaaccatgatttctcattttgagttggtgttatatcatgtgcccttaaaataaaatgatgcaatatacctaatatatctctatgtagttggatattgtgtgtaatctaaaatcttgagctgggcgcagtggctcatgcctgtaatcccagcactttgggaggccgaggcagggattgattgacctcatgaatttgaggcaagcctgggcaacatggcaagaccttgtctctatcaaaaacacaaataaataactgggtgtagtggcatgcgcctgtggtcccagctactcagcaggctgatgcaggaggatcgcttcagcctgcttgaaggcagaggttgcagtgagtcaagatcctgccactgcaccctggcctgggtgtcagagagagaatgtattgctaaaaacagtttccaagtgccaaggaacttcagggttccgaattgtctatgtcccagcatttctgttgattcacattcatttccatcttcattaagatttaagaatcaagtacaattgacccttgaacaatacaggtttgaactgcacaggttcctttatatgaggattcttttcaaccaaacacaaatggaaaatatagtattcctgggatgtgaaactcatgtatacagatgggctgacttttcatatatgtgggttccacagggccaattgcaagaattgagtatgcatgaattttggtacatgtggtagacccgaaaccaatcccctacatataccaaggaatgactatgtaagcaatgtcatgcttactatttacaaatttatccaatattatgaagaaaataatttttctttttgaaagatggaacaagggtttcatttcaaaagaaacaatagacaataatggccaatcaacaagaaccaaactaagtagatattaaaggtattgttattacatttggaagccagaacaatttgcgaattgaatattgaggactagaaaattcaggagtataactttctggaatgtcgaagctttggaggagaagtagaaggtaaagtgcggggccaggtgcagtggctcacgcctgtaatcccagcactttgggaggctgaggcgggcagatcacaaggtgaggagatcaagaccatcctggctaacacggtgaaacccagtctgtacgaaaaatacaaaaaaaaattagccgggcttggcagtgtgtgcctgcagtcccagctactcaggaggctgaggcaagaggatggcgtgaacccgggaggcagaggttgcagtgagccgagattacgccactgcactccagcctgggcgacagagtgagactctgtctcaaaataaaaaacaaaaaacaaaaaacaaaaaacgaaaggtgaagttcgggcttatattctgtagccattttagttaaccaggagccccagattcctttacagctgtcagaaagagctaatgggaaatttagcctattttaactgagttgtctccagcccattgcctcattattaaaggttagtatgcctttaagtcccattgccaacctatactgagaccataccttagcaattgcaaatctttgatggtcaaggcgacttttcatgccctccagatttattttcctttctttcttaacatcatagccttttgctctttcttctggcatatcagtatgccagatactttctttgtcaagtgtcaggcagtgggtctagagacttgtaccacccctttagaaagccacagtatggccctgagaatcattagtttctgaaaaagaactttgatgtgcagaaataagtgtcgtagatgacagctattagcttcctcatgaagtacttgggtcaagagactgagttcaaaaggacttttagttattcacacttccatatttctactttgactttttttcccaagcaatgcgaatgtgttcaaatgtacactttttaacaatttcttttgagtatgcccaaactgttaggttgtgtgtatgctgtgatttagcaaacttaagaaactgtaaatgaacagaaaacagaattattaagacctgggatgcctataaccctgaattcatctgccagttaactttctgtacagggtaggcgaattcaggcttcatggctgtttactgaccttcctcgaagtaagagagacagctattaatgacttgaaatgttatgaacgtggcatagaagtaatttggaaagtcagtttttcatattttcctcctaaataattttctattacctttcataaaatctttttattaaggtataatttacatgcattatacatcttgaattaatatgtatttatactgtcatgtaatcaccatcctatttctcaactgatcactaaaggttattttgcctcctcttggacttcacataaatggaattgtactgtatgtacttgttgtgtctggcttctattagtcaaaatttttttttgatatccatgtttgtgtatatctcagcagcttgtttttattgcataaatatagcataatgtatttatttttactctcttactaatgaacctttgggttgtttctagtttgaggggattatgaatgaagctgctatgtacacttataccagtctttttgtgaatatatgcactcatttcttttgggtatattcccaggagtagcatttctgagtcataaggaggcaaatatttattttcattactgcccaacagttttctaaagtgttgtactcttttaccctcccaccagcaatacgtagtaggtacagttgttctacattctcaccaacacttagtattttcagtctttttcattttggtcattctggtgaatgtgtagtggtatactactgtggttttaatttacatttccccgatgagtaggaatattgcttaccttttgatgtgtttattgaacatttggatatcttctttgtgttatgaccattcagacatttgttcagtttttattttacttattgatttctgagggctctttgtatattctagacatgagtattttgttagacatgtgtattataaagtgaatattttgttctaaacagtgtcttgaatttttactttatgtttactttgaatatgttggtaatcctagggacctgtgaaatatgagggaagtgtgcagcagggagaggaaactgtaaggcaagaagtggacccaccttaataaggggaaaacaagaatgacatttaacctgcagagcaatttcacttggagacaaggacagctggtcccttgaatattggatggtggcaaataagacatccaagcactaagagggcaggcagagaagagttgagaatgaagcaacagcatgcttatggtggctgatggccgggtagtgagtagacaagagtggggctctggacatagatggtctgaatttgagtcctgtctcccacctactaccatcttgtgaaggtacttaaccactccaagttcctaattttaaaaaagcaaaagtaggaataatgcgagcacctacttcatgggtttgttctaatggtatactacctatccccatttttcacatattgtgaatacttaatatataacatcaaaaactgcaactcctatgctgggaaaatattagaacaaataatgtttgttgttgttaatatttgtttacttattggaattggcttcagagatactctacaaataactcttggggtagagatggatgttctagcagatttgggagtcaatcagaaattggctcctgtttcagaaagttacagttattatggacttgtgacatttctgttcagaagtctgtatctggcatcttcccgcacacatgtcttgctttcaagtgctgttcagttatgtttggaatgagaatggtggtctccctacttctgcttcacttcttccacaaccttgctgacttctaaatagtttcctgcttagaatccttaggaggaattaggatctcctttcagccctatcttgggcactgacttacattcccacatgtggtccatgtgcccctagacaatctaaggagagtctagcttgccacacatgtggaaatcattcccagttcacaggtgggaagttatgggaatgaagaaaatgtgggggaggtagcaataaaactctctacttacatttcattgctgcatctgctataataaaatgagagccaagagcaacttattcccttgtgacatgatgacacacctctggatagatgtatattcagggatatgggtgggtggagaatgttacaaacactttctcatccctagtatcctattacctgtctgaagaagtacactgtgtaccttcgtatcactatgtcctataaaaaaagaaaatgaaaagaatgtaaaagaagacatggtcacttttggggataaatttaactacccaacagagagagaagaattactttattcatataagggttcattttacaaggatcttccagaaatatttccttgatttgtgtgctattcacagagggactggtcacagatgccagttagacattggattctttgactaaccactcttcatcttgtgctcttgagtacaaacagtacgttagagagaacattaaaaaaaagattgttttcagcaatttattcctgaatcaaaatccaaacagaaaataaaaaaggaaaaacagaaggctggatcagacacatctgatctttcaaatttggccttttaaacttaagaaggtattaatgggcatttcatattttaaataatttggatataagggtgtttataaagctagagattgtatttcacagtctaccatgaagcctgtaccttcatgtttgatgtatgttcaagctttaagtgatttatctaagttcttattgaatgttatatggaagatctataacccactaggcaaagcttcccaaaattgaaaataaaacacataatcatgattgtgaaacattctgtagaaatatagtattcttgagctagatgaaattttaaaagtaatcaatgccaaaaattgggaaacaatacttccaataatcttgaagatgcatactaagcagacaaaattggattcttttggttttgattgatttacatgcaatttatgattgtagtgtttatctaaacttctcaggatactcacaaaatatcacaagccttttattttaaagcattgttctgatttaatcttatctgtctttgccttaaactttgtaaatttgtgattatttttgttttgttttgttttgttttgtttttgaaacggagtcttgctgtgtcacccaggctggagtgaaatggcgtgatctcggctcactgcaacctccgccccccaggttcaagcgattctcctgcctcagcctcccaagtagctgagacgacaggcatgtcccaccacaccaggctaatttttgtatttttagtagaaatggggttttgccatgttggccaggctgttctcaaactcctggccttatgaaatcttcctgcctcagcctcccaaagtgctgggactacaggcgtgagccatcatgcctggccccaaatttgtgattttcaagattaaaattagattctaagagtgatggagcactttaaaatatctggataaaaatcatcttatttccagaatcagggcaattcttgaatctaatctaaaataagcaatgtaaaaatgctgacttttttctcacctatcatagactctctaaaaggtttatgctatatctgccatgccttcaatttacaaaataatatgatcatgattaaactccagtgtctttttcaggttatcacagtaccttttcattattgtagtacattctggtgtccccattaaggatatgctgaatggactgatactataccacagtattttactttatatctgtgtgtcagtaaagcagcatgtaccaggggaaggtttacctttagaaatcaaaggcttctatttcaccaggctcccacgttgttaaaaacactaaagagggtgacaacttctgcgttcaccaacatcagagcatctagtccctattttcaaaactttcttgtgccaatatgacttgttttagtaatagagattggttggggaatcccatattttttaaggcaaacccaaggaagcatttattttaccgtgaaaagtgctagggcacaatactatattaagcacaaggcagaactcaacaaagccctttcctttgattatttccatcactcaataataattgttccactccatagatagtttctttgcaacaaacactgccctggctgaccatccttctgtaatgcagaactgtgaatcactgaagtgtttaaggagagcttataattctttaaaagcctttttattctgttttacagtatttgtgtttatgaaaaaaatgcaggtaaaaatattctgaccaaattgtatttgtttaattattatgtattgcataatgtataatactgattcaaacttaacatgaccagagtgcattgcttggagaaatccaaaatgaaaaatatattttcagttgaaattcattaaaggatgaagtaatcaaactttttttctctacaaatgagcactacaaaatggcaaaagttttcttttaaaaaatctgtatatagaaaaaaactatagaaaaaatatatcacttcttgggttaaacacacttccccccaaccaaaaaaaaattctaggtacttagaattctttctagaacttagaatttccatattatttttcatcccatttctctcattcatttagaatctgccctccagttgaaaggaagtagatggagccgggcacttttagattatttcaaatctgaggaattcaacaaaaataaatgctatttagttatgttgtttgaagtcatgtatgcaacatatctggatgatgggtcaactttgtttaatagattagcatcatttacactgaagttcgtggctctgagcttcgttaaagtgagacctttgtccacattcccaggagggctttttctcagggggttctgaattttaccatgacgtaattcctaaacagttgtgattagtgctaaatgttatcataaacacacacacacacacacacaccccttgctgtgtgaaagctagatatagatattaaaaactttagaatacttgttttttaaatatgtaatttataatatataaataatatttagaatataaagtttataatacataaatactatacttctttaccattcactttctagaactttcccagcttttgatcacatatttcaagggtggtctccctctttactcctctactaactcttctgtgtctcagttaacatgtgattttggctttcttatttctccaacattatttaattcagactaactttatttcttgaaggtatataccagacatacctcggagatattgtgggttcagatccaggccactgcaataaagcaaatatcacaataaagcaagtcacacatactttttggctttccagtgcatataaaacttatgtttacactatattgtagtgtgtaatagcattgtctctaagaaaacaatgtacatgccttaagtaagaaatacttaattgctaaaaaaaaaaatgctaacaaccattagagccttcagcaagtcagaaacattttgctggtggagagtcttgcctcaatgttcatgactgctgactgatcaaggtggtggttgctgaagattggggtggctgtgacaatttcttagaataacactacagtgaaaattgccacatccattgattcctcctttcatgaacaatttctctgtagcatgcaatggtgtttgacagcattttacccatagtagaacttctttcaaaattggagtcaatcctcttaaacgctgctgctggtttatctactaagtttatataatattttaaatcctttgttgccatttcaacaatgttcacagcatctttaccagaagtagattctgtctcaagaaaccattttctttgcttcatccaagaaacaactcctcattctttcaagttttatcataagattgcagtaatttcattacaacttcaggttccatttctaattctagttctcttgcaatttccagcacatctgcagttactttctccacttgaacccctcagagtcatccatgagggttggaatcaatttcttccaaactcttgttaatgttgatattttgacctatgcctatggatcacaaatattcttaatggcatctagaatggtgaatcctgtccagaaagttttcgacttactttgccctgatccatcagagaaataagtgtctatcatagcgatagccctatgaaatgtatttcttaaataataaggcttaaaagttgaaatgactccttggaacatgggcttcagaatgaatgttgtggtagcaggcatgataacattaacctccttgtgcatctccagcaaagctcttgagtgactaggtgcattgtcaatgaacagtcatattttgaaaagaatctttttttctgagcagtatgtctcaacagtgggctcaaaatatttagtaaaccatgctgtaaacagatacactgtcatccagtccttatttttttatttataaagcacaggcaaagtagatttagcacaattctcaaaggccctagaattattggaatattaaatgaacattgtcttcaacttaaagttaccatctgcattagctcctaccaggagagtcagattttcctttgaagctttgaagccaggcattgacttttcctctctagctatgaaagttgtagatggtatcttctcccaatagaaggctattttgtctccactgaaaatctgttgtttagtgtagtgccttcatcattgatcttagttagactttctggataacttgtcacagtttatacatcagcacttgctgcttcacttcacactcctttttttttccagcttttattttaggttcagagggtatttatgcagctttgttaaatgggtagcttgtgcaccctgtacttttatgtattggagatggcttcttttctttaaacatcatgaaccaccctctgctggcatccaacttttcgtctgcagtccttaactctctcagacttcattgaattaaagagagttagggccttgtttgggattaggctttggcttaagggaatgttgcggctggtttgatcttctatccagaccactgaagttttctccacattatcaataaggctgtttggctttcttgtcatttctgtgttcaccagagtagtacttttaatttccttcaaaagctttttctttgtattcacaacttggctaactggtacaaaaggcctggctttcagcctgtcttggcttttgacatgtcttcctcactaagccttattatgtctagcttttgacttaatgcgagagacctgtaactcttcctttcacttgaacacttataggccattgtaaggttattaattggcctaatttcaatattattgtgtgtcagggaatagggagacctgaggaaaagagagaaattggggaatggccagtcagtgaagcagtgagaatacatgcaacattaatccattaagtttactgtcttacatgggcatggtttgtggcaccccaaaaattaaaatagtaacatccaagaccactgatcacagatcaccctagcagatataataataatgaaaaagttcataatattctgagaataccaaaatatgacatagaaacacaaagtgagtacatgttattggaaaaaatggtgccaatagacttgcttgatgcagcattgccacaatattcaattggtaaaagcacaatattgtgaagtgtgataaagcaatgtgttagtctgttttgcatggctataaaggaatacgtgtgactggctaatttacaaagaaaagagatttatttggctcattgtttagcagggtgtctgggcaaggcaccagcatctgcttggcttttgtgaggcttcaggaagcttttattcatggcagaaggtgaagggggagcagctttgtcagatgacaagagagggaataagagagggggcaggtgccatattctttaaacaattagatctcacaataactcatgaccacagggagggcaccaagccatttatgagggctctgaccccatgacccaagcatctcccactaggcccaccatcaacattgggaatcaaatctcaacatgagatttggagggtataaatacccaaaccatatcaagcaaagcacaataaaacaagtatgcctgtatttatacacatattacaaaacagaattaaaaacaataaaatcatacatgcaagggattctggtaaatatactgatcccctcaatcatgcattagtcatatattaatgtattcactttatattcaaccaacaaatagtgagagtctgatatttgctgtatactgaggtatgcactggcgacccaaggctcaacaagacaaaacacagccttttctttcacaggggattgaatcaagtagggcacgtgcaagaaaatagaccactataatcttgtttgtttcatataatgtacaaatatgactgcagacaaatggagaaatatgaaatctcactggggagcaaactcactttggcttgtgaggaactaacacctaacctgagaccaaaataagatggttccaggaagagagaacagcaggtcaaagtccagggatgagattaaagtagagtgtctgcacttagctaaataaaaactgctaaaacatggctagaccagaatgccaattgaaggtacagttgataaaacttaccattaacttttcatgtaaccaatatgtgaggttttgtaatattttccagtatgctaagcagctatgatataaacactgaaaaggcaaacagttggattattccaaaattggaaagcaggtgcaatataagaaaaatagggcaagggatttgaaggtatttgaaagaaagtgatagaaatgatgaattgtggcaacttagctggttatggaaatgagtgaatataagaagatactgatatagaaagtattcaaggtctctagaaatctctatgatgtcaaacaggtgaattagaataactgagcaaacaaaagatagatcatatttggaggacagaatgaactttaagatgtaagtgctagaggtaatttaaggtatgttcaagacatagaagggtgtcagggaagagggtgactgccttggaaaagatgtagctgaggaactgagagatcggggcatgaggtgatgcctccacatcaacatcaaagtcacccaggactgcagcaggattcaagctgtcaagatgacaaaaaggtgggcagttttcagtgaatgagaaactgaccaaagggactggcagaagtcagagacaaggaagtagagttgattggcatagatgtcaaacgagaagtttttacaagaaggtggaggagtaagtaaaagtgagtaaccaggagagcacccatttcatcttgggacccagagagggcattgagaaccagagtaccttaccctgaatccaccacagggaagtgacatctttagcgaagagtcaaatttgagagaggttaggatctgggatgactttttggtggcaaggctgaggatgaagtgaagtctgtttgccatgggaaaagggatccagagaaactgattgaataatatggaaagaatgagaatgggaggatagacaggggagagaaatcacagtgcaacatggggataagaagttgaaagaacacagggagaggaagaagctctgtatcaggtggttgtctgagatatgattatgaaacagcattccaaaatattttcaataattggtccacctgtcctctgactgatgggtgttaaaccagggaacaagaagttgagcatagctagtaggtcttttggaaagaccataacgtttgtcctagtcccagtaagtaggtctgcaatggtgtccttgggttcctagtacatttcagcatctattggagaataggagcttctggtgtttcagtacttctgcatcttccagattactcagctgtttcccagatttattacagtctctggagtatggagaaggatctgattttttaaaaaatatgaattatcattttcaaagtattagtttattttaaataatttttatatctaactctaatattttgccagcaataataacatcttaggtattttgaattagcatttgagtttgcttttgagaattttagttcttagaaataataattgaattaaacactattgctttcttatatattcttaaatactatttctggcattcaagcattattccagttcgtcatgctgccaattttagcaataaaataaagaataaaattgaattcaatgtggaaaaattctatttgtagaaaacattcgtctgtaaacggggttactgttgtgaccttagtgaaacaacagaaaggcacgtgcatacggttttgcccttagcttggatgtaacatattatttgcagactttaagtcatagcaacctatgatcatgctaatttttatttaaggctatttgatagagttgtatgattgagacctggaaccaagatccttgatgtaatacatatgtgcacacaatttttttattctcttctctttggtgaccttgtctgggtcatttttttgtttgtttgtttaatttacactgtttgaaacagtatctgtgactagaatttggcaactgtagagtatatcatatgtacacagtgccttagcaaagggttttaattaaactcagtggaggagacccaagcagaggagccttcatttgtcttaagaagaaatgtcaaggttaattgattttcagaggattatctgcaacaaataaagaccaagactcatatcttcttattttggcttataaattctggtatgttctgttcaatatccactgaaaaaaactgagatgagagtgtttctataaaactctatatgtcaaagcatcctttgcagttggcaaaactgaatgaatgacagtgaaaatgtatacttatggattatgatatagtcattaaaatgattattatgataagtatatggtaacatggaagtatttagaatgttttgaggagaaaagcaaaatatacaagtatatccaggttaaagttaaaacactgcaaaatatatgcctgcatgtggctgagaactggaaaacaatgtgaaaataatttgaattttttgatttacaaaattgtggttttttatttttctcacattgatttctattaatgaaaataagtgtttatccaatcaataaaattacattaaaatttattatttatttacaatttcattcatacaaattcatctattgtgtcttagtatatgacagacacagtttgaggtactgggaatattttatatgtagattttaaaaattcatgaacttttgtttttcacaggcaatccaataggaagttttggcaactatggtgggaggtagggatacttgggcctttcagaattctccagatcactttgtataaccattcctctgttggtgaccgactccccaaaaaagatcaccagcagaaccaagtgaaactaagtattcatctcagtgaaataagggaggacatcacctttaaaattagtagtattttggaaaggggaagtaaagggaagatatttgtagagttttatagccaggtctgggagcctgatcttgcaaggtggaaaaatggctggcattaggcagaatttagagcctagcagttctggattagtggggtctctaagagcagtgaggttctcaaagtgaaccttgataagtgaactgttagtcttattgaataagctggttcaggccatttacagccttattttccaaaagcaaacatttcctggagcaagtacctaagttatttttgcttggtctccatgtgctcagcattaaaacaggcatttaaactttgactccaaattgtttagcactgggacagaaaagtattttggtttcagtttttaccttctttgtgagcgacctaggtttgatcaactcatttggctgacaagccggatcctttgtcccttattttatttttttagacttatattattgtcacctatattgcttggaaatttaggaaacacagtccttgggatagctggggggatgagaagtcaagagaggtaaggtcttagggtagacaactgggtagatactgggctactcagtatccaatcctcttctgttttgggggagtttcagaataggtgagagaaaggacctagccttccactaggggagtaggaatatgcattccctctgcatgcccctctggcagacagagggagggtctataacctcaatgtagtcaatctgatgttcctagccaggactttgaatcttgaggggatggctcagaccatcacatatgccactatcgagtggaagggccagtggcatctgttgtagctgctgacagtgtggcgaagagcagtgtgtgcccagcaggtgaggaatagggtcccaggcagactgatccagcctcccagctgcttattatcttcactggattctgctcaagtctgcttcttcaagctccctgtttattctgagttctatcctatattcttttgatggattccttttcctgcttatgtcaatccatcatttctattgtttgcaaatcacagcccttgatcactctagaaactaaagtacagaaagtgccctgactttgctagaagtttaggtgtaaaattagtagtaaagttagtaaggaaaaaccaaaggggaagattgaattttattttaatgcattatttttttacataaaaagataacaaaaggagggtagtgaagagaagagtctcttgagatgtccgtggcaaagtttttaaagctctcaataaggagacaaggactgggcttcattgcaattattcccttttgactgttgaagctggtaggcttacaatggactcctaatgagagtggtttgcactacaattaattaagtgcatgacattataaactgcatgtctcttccctctggagaatattcttcctatataagtgctattttgttttaatttctctctctgtctcttcctctctgtttccctctctttgtctctctctcttttttatttatttatttattttttattattatactttaagttttagggtacatgtgtacattgtgcaggttagttacgtatgtatacatgtgccatgctggtgcgctgcacccactaactcgtcatctagcattaggtatatctcccaaagctatccctcccccctccccccaccccacaacagtccccagagtgtgatgttccccttcctgtgtccatgtgatctcattgttcaattcccacctataagtgagaatatgcggtgtttggttttttgttcttgcgatagtttactgagaatgatgatttccaatttcatccatgtccctacaaaggacatgacctcatcattttttatggccacatagtattccatggtgtatatgtgccacattttcttaatccagtctatcattgttggacatttgggttggttccaagtctttgctattgtgaatagtgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgcttcctgactttttaatgatcaccattctaactggtgtgagatggtatctcattgtggttttgatttgcatttctctgatggccagtgatggtgagcattttttcatgtgttttttggctgcacaaatgtcttcttttgagaagtgtctgttcatgtccttcaccactttttgatggggttgtttgtttttttcttgtaaatttgtttaagttcattgtagattctggatattagccctttgtcagatgagtaggttgcgaaaattttctcccattttgtaggttgcctgttcactctgatgatagtttcttttgctgtacagaagctctttagtttaattagatcccatttgtcaattttggcttttgttgccattgcttttggtgttttagacatgaagtccttgcccatgcctgtgtcctgaatggtattgcctaggttttcttctagggtttttatggttttaggtctaacgtttaagtctttaatcaaaagttgtccctgaaggaaaattaactctgctgttagtccactgagaaagcttctcttttaatactggaacatatctttgtctaactctccctcacacctagtgctaaatttatcagcgttgttcctgatacaaacattttgaagacaatcgtgaggaaaaagatgaaaaaagttgcatttaacttttgttacaggtgtccttgttctccagaagttactgtctttgttgtagtgtgcatgcagtcacaggagtgtgcatacatgtgtgaagtacttgagaagtgtatttgtccgttctcacactgctataaagaactgccctagacggggtaatttacaaaagaaagaggtttaattgactcacagttcagcatggctggggaggcctcaggaaacttacaatcatggcagaaggggaagcaaacccttcttcacgtggtggcagcaaggagaactgcagagcaaagtggggaaaagcctctataaaaccatcagctctcatgagaactcactatcacgagaacagtatggaggtaactgtccccatggttcaattaccttctaccaggtctctcctgtgacacatggggattatgagaactacaattcaaaagatgagatatgggtggggacacagccaaaccatgtcaagaagtatttcagagacaagtcattccccaaaccttatcatcagggtcaagacctggcaggtgagacattagcaggtgaacacaacattctcagaaacccttgagagtactcctttccctccaggcatcttctttcaaccttaatatattctattcaattatattcacagctttttacctcaattataattccattcttccaaatttgttttcttctcccatctttcctcctaataaaatatctattcttcagatagtcttcctttgtaaaatagaaaggatctacaaaagccattctttgtgagatgtgaatcatttcaaataaattaatgccttgttctaatgtgaatggtggacttgtgaagagaagtgggtagatatttgaatttctgaatgctttagaatattagttgcacatgcagtaatatttcctgtagcttagaagaaattggttggcttaacagaaaatgcaattaaaatagtttacaaataggttctggcatcaataatagaaatattaaagaaactacatattatatcaagatgcttctctttttttcggggggggggtgccttttcttccttgatgaacacagtactctttcttctttgtcttttatcttccatctcaaattgtcaataataaatttgaagaatggagaataatacattatcacgtgccagaccttatgctaaacactggatatgttatattgtgtttcatactcaggatgatgctacggtaggtaccattattatcttattttacttataagaaaacagaagcctggagaagttaaacaatttcctcagtatcagaaagaaccaagatcaaatatctaggttaaggtattttatcttaacctagatatgccagaatatcaaatctaggtttcactattattttgtattctatccaaatttctaaaactgctaatgatggagggctgttatatggttctagctttatatatttttttatttcaacttttattttagatatatgggtatttgtacagatttgttacatgggattattgcatgatgcttaggtatggtatatcccattaccctgatagtgagcatagtacaagataggtaattttttaatgcatcccaccctccctctaccctctagtagtccatggtgtctattgttcccatatttatacatatgtccacgtgtgctgaatgcttagctctcacttataagtgagaatgtgcaatatttggttttccattcctgtgttaatttgcttaagaatatggcacccagtgggccgggcgcagtggctcacacctgtaatcccagcactttgggaggtcgagacaggtggatcacctgaggtcaggagttctaaaccagcctgaccaacatggagaaaccccgtctctactaaaactacaaaattagccaggcgtggtggcgcatgcctgtaatcccagctactcgggaggctaaagtaggagaattgcttgaacccaggaggtggaggttgtggtgagctgagatcgggtcattgcactccagcctgggcaataagagtgaaactcactctcaaaaaaaaaaaaaaaaaaaaaaaaaagcatatggctcccagctccattcatgttgctgcaaaagacatgattttattctgttttggggttgcatagtattctatagtatatatgtaccacattttctttatgcaatctactattgatgggcacctgggttgattccacatctttgctattgtgaatagtgcagtgatgagcatatgagtgcatgtgtctttttagtagaattatttatttttgtggaagtatatacctggtaatgggattgctgggtcaaatggtaattctgttttaagttctttgagaaatctccagactgctttccaaaataactggactaatttacattcccaccaatggtgtataagcattcccttttcagcctcgccagtatctgtcattttttgacttttttataatagccatcctgactggtgtgagatggtatcttattgtggttttgatttgcatttctctgatgattagtgacgtaagcatttttcatatatttcttggccacttgtatgtcttctgttcatgaagccctttgcccactttttaatggggttatgtgttttttgcttattgatttgtttaagttccctgtagatagtgaaaattaggccattgtcatatgcatagtttgcaaatatattcttccattttgcaggtcttctgtttactctgttagtttctttgctgtgcagaagctatctagttggccatcttggcatctaatctttaattttctttctaaaatatttgaatgttttgcaatttctgactgaagttacttccctctttctgaagaaggccctgctgacatcaataattatctgagagtgacataagctgactccgattatgccaaagtaacccttacgtggtatgaaaagaaaatgaaggtgactatgattcctggggcatttgagattctgagaaaactccaggtcagctcgccataaaaattccccacacctgtagtttaatttaccaattaggaaattatatatttggggctaaatggtttctgatttgttggcctgaaagaaataatgtacttttaacaactataaaagttctctgctaggaatatcttaaatacagtgaaaatctgccttgacagtggacagtaagttagatttcattgttgtaaattggcaccattaactaaaacccttgtccattcaaaataatatgtattgtcacataacactaagctctgttattaaactgccacagattattgctttaacagtttgaaaatgatttttagaaaattgactttgtacaatgctatattagagtctgttaattgatgagaaaaccaaactcagatgacatttgcaaaaataaaattggcatcagttgaaacatctgtaccatttctcttatttaaaagacatttttcatctggaaaatgactacttcgattagcctcagatcacaaccacaaaataaagttgtctatgggtggcttcttatttgcatttaaattattatgttgcagcattttgtatgcacaagcaaatggaagattgttttgaatgacataggcctatacacctgagagagaaatatgtcatctacaaaatgtaaaaatataggtttttgtaaatgcctctgaaaggattataagaatctacattttcccctccctcctggagtttgtctttctattaaggctctagacgaagaaaagctctaatatactttccttggaggggtcatgagacaatgaagcataataggatttgaagtatattggatataaaattcatgtgatatcctcaagtagagagatgttattttactgttctttaatctttactgttggcgataattgcctttgtaaactaactttatgttgtaaactagtagcgaaccagagattgagttgagaggtgggggtaacagatgagatcctcacttgtgagggctccaagggcctgtgaggcaatggaaagggctgaccttgctacctggatgggaacaatgctgttatcattttcatgtgctcctgtttagaagatgagttaacatccataaaaacaagttagactaagggttgtcacactacagcctgtgggccaaatgctgcctgccacttgttttataaatgaaggtttcttggagcttgcactactactgcagagtagagtagtggagatggagaccattcggcctgcagagtcaacaatgtttaatatctggtgctttacagaaaaactttgccaagccttgatttagacttagtaactttagtaagaagttactgactgcacaaattaccaggatatttaagcttgtaaagtattaaaataccataactatctgcttcttgtggcagggagggggccaaggagaggtgaagtggttataatgctcgtgcattggttccttcattcaccagagtgattgtgcgccctctctgaaacagggataatgccaggtactcaagatacagcagtgagcaaaaagaggcatagtgccttccttaatggagatatgcattggagtcacatagcatataatgttgacaaatatccctgctctcatggatcaagaggttagagttttagggtaaccatggaagatctcactgagaatgtaactttgaataaaggattagaggacttgaggaagccaaccatgctgctagagtttctctgcagaggaaaggggagtgatgagatataggtgaaggacaatgtgagccaagattgttttttttaagttgaggaattaacagcatggttgtatgctgagggggacaattcagtggagagggaaaaattgatgttgcaggaaattgctgggataatgtctttgagcagataaaaagggattgatccagtgtacaacagaagggactagtcttggttttggatcaaggacagtttatccatagtaaaataagagaacgtagagtatatgggcacagatgcaggtcattgggtagtcgtggtggttgaaaattgtagaagttctttttttaaaactttaatttttcttagtatgtgcaaaggccttgaagcaaaatagagcatggtataatcaaagaattgagagaagaaaaacataatctaactgtaaattaagcaataccatggagccagatgaggctgacgaggtacacaggatacagacgtcagcaagactaagaatatggtaatgctaaaccaattaagaatggggttaaatcaaatttgcctttttaaaaaaagatgactgtggctactgatagagattggataggagagtgcaacaagagtttctgtggagagaccaatcaggaagctactgcagtaattcaggtgggaaatgaaggcatcatggtctagagtagagggagtggggagaagagaaatgatcagattttgagagatatttagaggcagagtagatagacttacctcacttatgtttgggtatagaagacattgcctatgtaaagactgagtagagaagagagcctaggagtagatgtggacactcaggagaaggattgagatcctggtttagaacactgagtgaagaagctgggtattgttaaagaagagagccaaacttcacaactgcctagcagtgaagaagcagatcaacaaaaatcatatggtgcggaagggatacttgccattagattagtccagctgaagccaaacgctggttgcttctgatttttttaaatcctataaatatattggttaattttatttaaaaaaattgaacttttcattctcataatgagaccaaagtaaaggtcaaaatcttaagaagagaatgggtcagaacatagcaggcagattgttgtttgacatgatgtcaatggacacttcagttgtcatgttctaggcccattacattggcctttcctcttttgaagcttctctcatggaaccaagtgcattttatatctgcatctgttccaaatatgggtataacacagactctgtgagtagcctgcaatgtgtttcccttccacatattgctagataactctgcttataaaaatctgcttgcaaaaatcatagaacttgcagatcctgtcaaaagaattactattagatgaagttaagaaatgactgtagaagtaaaagaacaagagctggtcttaggagttccatcccttcatcagtctaggagggttgggatcttagaggcatttttgagctgaaaactcaaggcaggaaacaagccatcccactctgaatagggctgtgtttctcacctgaacagtgagaagagggtgttatattttctaataaaatcccacattaagttagacaaaaactctgtataactatggaatagactttactaatggaaagagtaatgtgaaaagctaaataggaaaattttaggcacgtattttcacaatagatcttgctgtacttgggggaggcttgtcttcttgattactaaggttaacttagtgcttcagaagccagcccgtttttatgttctgctgttttcctgattttggtgtgtcttgatgccactgtgttctagtaaaaattcccttcaatagactgccaggagagcagaccagggagtgtgagtgttttgtgcatgggcgagcacatacagatgttaggtgacagtggttattcagtcatgctttcagacctggagaacagttcaggtcaaaatctccaagtctgtggaatgaagctttgggggaattaatcaaaatgttactgaaagaaaagggaaatcaaatctgacttccacccctctgagatttttgttgaggacacagaatgagagcataaccttcaggtccagagtggaatatagagagatcttccactgacaatatgctatcaacaaaagcaaggtagagaggaaacgttgagcctcagcaacctgtaagtcaagaccctctccatcatccctagatgcttttgctctgtcattgggattgtgtccctttctataacactgtgacttctttggatctccacagcctgactgtgttcacgttctcctctccagtcttttagtttctcttacagagctggtgcatttctgtggggacagagcagctggaacctgggcccgaagctggttcagatatggaattccctttaagagcaaaaataacaattactaatataatacaagcccaatacaaagtgaatagttaaaaggagaaaagatatcactatgaattcaaattttaagttaacatatatcccaactaccacaaaatattataaatcataacattttattaactgcccaacccaattttataatacattttcccctatgcttggctaaatattctttgattgtctctttaaatgacactgaaattgtaatattttctatgtagagattgggaagatactttaaacttttcttcaggattgttgatttttaaaaaattattaatagttagaaaagttttgtaatgtcatatacattcttaacattgttatcaaattttgagaaatatttaaatttttttttcatgtaggagcgtaagatttcagggcattcgatgtggtgtgtgtgtttgtgggtgtgtatgttgactaatcttacatacttgtattcttttaccagtttgtcatcgaagtgtcactgcatttgtcatgagatttagatcctctctgtcaatgtcaacattttatatcaaatcagaaaaaaattaaaaattgtttcaatgtgtgttagtttgattaactccttttcattaatttacttgtcaagcaacccaagggccaattcatcatatctatttgaaatttatctctttctcttattgaattaccacttttgagatgatctggaaaaaaattgttacaatgtactgtctgatatctgaataatttctattgatttaaccacttggctttactgcattttcttcatactccaataattgtatttgaaattttcttattcatttatatttttagtcctttaatctaaaaaaattaaggataaaaaagcatccttcacgtatattgaaatcaggagtcagtaatttttcacttgtttaaacattcaaaacatctttctaactcacttcttgatattgggataattttaattttacttttgcaaattttgccaaagcatctggctaaataaacacacttgccagggcaccgccccagagcctcggcaggtacttatgcaagcagagagccctgcagctttggcttttatcatcttcaccataaacccatctctgattctcccctttccctacagcactttccactaacaatacacatacacacccatatcacacctatactatttatttttctttatgccccttttctgtagtatttatatccatagcaattatcaccatctaacacactacatattttgcttatttatttatttattgtttatctctccacactagaatttaagctttgtaaaggcagatgtgttcctttcctgaggctgccatataaatgaccacaaatgggtggctcgaaacagcagaaatttattctctctgagttgcagagagaattctgcatctcagaatacagttcaaaatcaaggtgctgtagggctggttccctctggaggctctgggggatgattgcttgcatgcctttcatagccgccagtggctgcttccaacccttggcactccttggcatggggcttcatgaggttcaatctctgcctgtgtcctctcgtggccttttttttttttttaatctgggtctctgtgtcttctctttttctgatcttaaacataatttcttgaggaaatcataaatcattggacttgtagctcaccctaatacatggtgatcttatctcaaaatctttaccttaattacatctgcaaagatcctttttacaagtaagtttacattcttattccgggtgaacttatcttttgtggaccacagttcaactcactacagaagttacaatttttctgttatgctcactgatgtgtctccagcacatagaccagagcctggaatgtagtaagtgctaaataaatatttgttgaaggaatgcattgagagcctatagtgccagatgctgaggtaggtacttagagcactgcaatttaaatattccctaactataatttatcttctcttttcaattcacatataaatatttttttaattttttaaattttttattttagattcaggtggtacatgtgcaggtttgttacatggatatattgcatgatgctgaggttcgagtttctattgatcttgtcactaagataatgaacatagtacccaattggaagtttttcagcccttgcctcctctctccctcccctctttttgagttccttgtgtcactgttcccatcgttatgtatgtgtgtatgcaaattttagcttccacttataagtgaaaacatgcaacatttggtttgctgtttctgcattcattcattcattcattcaatggcttatggctgcatccatgttgcttcaaaggatgtgattttgttttttcttgtggctgtgtagtattccacagtgtatatgtaccatattttctttatccaatccaccgttgatgggcacctaggttgcttccatgtctttgctattgtaaatagtgctgtgataaacatacatacaagtgcaggcatctctttggtaggatggtttattttcctttggtattatacccagtaatgggattgctgggtcaaaatggtaggtctaattttagttcttttggaaatctccaaactgttttccacagggtctgaactaattttcatttctgcaaacagtgtacaaccattcccttttctctaccgtctcgccaacatccgttatttttttacttttcaatatagtagccattctgactggtgtgagatggtatctccttgtggttttgatttgcatttctctgatgattagtgatattgagtatattttcatgtttattggttgcttgtatgtcttcttttgaaaagtgtctgttcatgaccttttcccacattttaatggggttatttggtttttttcttattgatttgtataagtttcttatggattctggatattaggcttttgttgaatgcatagtttgcaaatattttctcccattctgtaggttgtctgtttacttggttgatagtttcttttgctgttcagaagctcttcagtttaattagatcctaattttcaatttttgtttttgtatgcaattgcttttggggacttagtcataaaatctttgcctaggccagtgtccagaagagtattttctaggttttattctaggatttttatagtttgaggtctcccatttaagtctttaatccatcctgagttaagaggtaggggtccagtttcattcttctgcatgtggttagccagttttctcagcactgtttattgaataaggagtcccttcccccctgcttatttttgttgacattgtcaaagatcagatggctgtaggcgtgcagctttattttggggttctctattctgtttcattggtctatgtgtctatttttgtaccagtatcattctgttttggttactgtagttttgcagtataatttgaagtcaggtgatgcctctggctttgttctttttctttaggattgctttggctattctgctctatttttggctccattttacattttagaataggtttttctaattctgtgaaaaataacattgataacttcatagaaatactgttgaatctgtacattgctttgggcagtatggacattttagtgatattagtcattcaaagctatgagcatgaaatgtttttccatttgtttatgttgtctatcatgtgtcatttatttcagtagtgttttgtagttctccttgtagagatctttcaccttcttgatagtcctaggtatttgtgtgtgtgtgtgtgtgcacctgcgtgtgtgtgtgtctattgttaagtgagattgtgttcttgatgtaggtctcagtttgaatgtcactggtatatagaaatgctactgattttcgtacattcattttgtatcctgaaactttactgaagtcattatcaggtctaggagccttttggtggagacattaggtttgtctaggtaaaggatcacatcgtcagcaaagagaaataattttacttcctcttttcctatttgggtgccttcatttctttcttttgcctgatcgctctgactaggacttccgttactatgttgaataggaatggtaggaatgggcatccttgtcttgttcccattcttaaggggaatgtttccagcgtttgcctgttcagcatgatgttggcttggggtttttcatagatgactcttattattttgggatatattcctttgatgcctagtttgctgagggtttttatcatgaagggatgttggattttgtccaatgctttttctgtatctattaagatgataatatggtttttgtttataattctgcttatcaattcactataagttctttgaagatgaaaactctgtcttttatggtgtttgtacattttgaatttcttaatactgtgtatgtagctgacaacacataaatagatatgcaaatgagtaagagagtcatttgggatcactgctgatttaacttatcttgccatgaaagcattctgttcctctttcccatgcttggtaatatatccttttggaagaaacactcttgccaaaagagaatggcattattacatccaagggaaatattatttgcccaagagtgtaaaaatgtatgaaagaaatatgtaaataaaatcctatatgtaaaatctaataatatcaaagtttaatgatgaaatttgtcaagatgattataaaatatcacagttaaactgtatattatattcatgtttcttgccatttgtatgctaaaaacttataatgatttgaatgtacaaaatcaaaaatcgggagaaaagaagatagatcagagcctattaccaataatttatcctttacctccataaatgtttgctagaaatgccaaaggctctaatttgtctatttaaatgtacttcaaaaaagcattccccaagttgcctatttactctgttatctctataaatcaggaaactctccaggctttccactgtgaatgttgtatggaattgatagaacaatttcttttttatgttgtactcattcaccatttagttacttagacaataaacttagaatgacaaattctaagtctcaaaatatgaatgaaaattcactcattttcagaacaaaatttagcatcacactctcttgagcaaaatctcactagaaaaaaagatagagaaaatacgttatagcatttgaagtctgctacctcatgtccttttatctgctttctaatttattagaaataaatatgcaattaaaatatgactttccttaacctttacataattataattattatgaaaaatatgtgtaaaaatatacatgttatattccttttctctatactaccaacagccactcccattcatgtactcatattagaagggaagagctttgaatatcatatataacattttcagataaaagaacttaggtccagaaaagctaactcttttgctggtgactaaacatacacatacgtgcactgacacacacatattaagttactgagttgatagcaaaaaaaaaaagtgcaactttatatggaagtagaattatgtaaaaatgtctgtctaattctatactggaaaatatctcatatgaaatggctccttcatatgacaacactcagtattcaaaagcaaagcacaacaactaagaaagttactttccccaaccaaaaaaaataataataattaaaaaaagaaatgtacctattgtggactagctgattggataccatggccacagccctgattttcagtaaagacatagtttcaagaatgtcattcagatggtttcttaagtagggatgttgttatttttagcaaaagaagccttttgtccttgtcacatcaaaacacaaagaattccataagtcagtgccagtcttgtttttaatgcctaaatatctggccacatatatatttatgttatgtaaatgttattgccttgtttttcagaataagaatttagaacattagaaattgacttttataatgcaatttttttcaaactctttttggcttttctctaaatctcaaaatttgtttcaatttaggcaatggaattggactagtcagtctaatttatttttgttagccagtttcacctctcagattccagggaacaaagccaaactataagatatctactgaaaacatttgtaagaaataattaaaagcagactctgaataagcatataaaatgaagcatttttatcacaagctttataaattttttaaaaactgtgttcatttaattctgaaagcatgcctcttttgtaattatgaaatacagaaatatttgaaattccccagtcatcttggctcacaaatagaaacatttggttgcgtttggttcacaagcacacaggggcctgctgcttttggttctgtgtaaagcccatactatttcttgctttttttttccacaatgagtatgtgggtgctagaatgttatcgaaatattttgcaagacatgaatctaaaatgagcactctgctatggttgcagttacagtgcaaaccccatcaagttgctagcattggactgatagacaaggtaggggcagccagagagtctgagttcctgtgaggaactgcaagggggaaggggctgtgttcaggggctgtcctgcaggctgaaggttgttattagttgtgtggtttctgggcccacacaaaactccaccttctcccattagaagtcagtgtcctgttgatgtgaccacctgctttattattcggggttttctgccatctaagacctgggccactcacctggatttttgaactcttgcttttgcactgatacctgattcagaatccgatcaattgcctttccatctttgtctgtggggaccagaagtacagaggtcttataggtgagcttttattctttcttccagaaagagtatcctataactgtgtcagtgaggaagtgaaacacaacctcctgtttgaaacacaaaaggaatttagagaggagtaaaatacagggccgtttaattattccctttaataagaagcagcatccccaccaaagaacatgtcgatcttacttggtgatacatttccctatggagaagggagatctgattgaaagaagaccgaagggcaggagggagggagggttgtaaagcaaggatgtggctctgtgtaaccgggataaaagcaccctgccttagggagatgttgtgagaaataccccagcaccctcctgctacaagaggcaatccttatagctggctcttgccatggttaaaatgattgggacaaaaatattaaaaaagaaaatgctcctcgctatactggttggaatcctcaggcttggagtaggaggagctgagtaatccctgcagtgtcccgaaagctggaatcctgagtagattcaggccaatttgtgtgatattcccagggattccctccctattttgggcagaggaatggatttggatggggcagcatgttcctgtgagttggcaggcacccactgaacagaataactgatttggtacccagactgcagataccagctgaattgccaagcagatattgcctgagggaaatacctgctaaagttgaaatgatcactacttggatgggttaaacatttaccagtatcaactagtattatacatagtgttttagtttttctgaaaatgtgcatgcacatgagaagaataagtattaagatgaaactcccagtccctctccagaggcacaaccatggttaccaatttcttatataaagtatatatataaaagcttatataacctcttcttttacttattaaatacttgcattgattactttagaatgggcaagtaaaaactagtttaattgtaataattgtaatcactctaatacattttcttattcctgaatatttgctttgttttaaactttagcaattatgaaccttatactagtctaggaaaattaatctgtaaatatttctgttggaatctcagatttataattaaaaaattatatagggtatgttacataatttctgatcaaagatttagattaaacaaatatgtttgtgcacttattacatcgtcagcactgtcctgtgcctcactcaatacgtgaacttatttaatgtaagtccacttaatttcactgtagaaaccaaggagaaaaaggtctggggcacatacatggcattcttgtgaatctttctgaaagtgctctcttacctgacatggtagggatatcctgaaaggtaagaagggaaaccttcagggcagtgccatttgcagctaggtctttgagaataagaatgaattcttattcaatatgctggtgccacagttagggctaaagtatctttagacctgccatctctaataataacggccatttctgacttgttaatcttcccggcttttttccctacaattttaggtctaaatcttccatgtaaacacactctttcatgctgaatcctgctcaaataactgccaagatgtttgtttagtaatcctgaaatagaagattggcttctatgctaagataattattgggagaatctcttcttttaataaatacctggttcttctcaaacccatgccaagaagaattcttataatatcatttcttctcaaacccatgccaagaataattgtcaccatatcatttcttgctattcatcccttttaaaactaagaaacaggccaggtgtggtggctcatgcctgtaatcccagcattttgggagaccgaggccggtggatcacctgaggtcaggagttcaagaccagcctggccaacatggtgaaacccgtctctcctaaaatacaaaaattagccgggcatggtggcgcatgcctgtagtcccagctacttgggaggctgaggcaggagagttgtttgaacctgggaggcagaggttgcagtgagctgagatcgtgccatcgcactccagcctgggcaacaagagcaaaactctgtctcaaaaacaaaacaaaacaaaaaaactaggaaacattaaagcttccaaggaattgagcgttaagtggggtctaacatttaatatgactgtagagtaactcctctttactaagtctttttactagtttctccctttctctcaaatatgtacagtttaaattggatgggtaaagcaaatgggagagtattgctactttttagtcatatttatacaaatgaattatataatattaattgttcataatattccttgtaatttatagcactgtgagcagtataaataatttgataagcgctgggcctgcccagcctttgtaatgtcttgtcaagagtagattgagaactgtgacatgatgttaggaaatggagatttacaagcttactgaagaatataactgaggcattaggagtgcttttctgatcggattaatgttcagttttattttcaattttatcaagtgagtgttaatgagaaatttagttggctccagtaaaatcattatttttttcctatgaaacatatgaaacctaaaataatagtctaattgtttcatttttatggcttcgaaattctagacaaaaaaaaaattctagacaatgtaaatatttaaccagtaaatattttgatgcattaaatcgcaaaatatcttttataattgctgcatctctcttccaaataactagaacccaattcccattttcacttttctcacataaacatgaaaccatttcttatagtctgtaaacatttctacataagtggctagaacatatactgccttatgtttaattgcatgagacccgaacttatttagtgagtattttgaaaagcagttaaagaaaaaagatgatgaaacattaatggctcccttcctccaagtagaagataagagtaatatacggtcatggagttcctttttaaggggatgtattagttttctatttctgcatataaagtcaccccaaagctttgtggcttaaaacaataatattttattctctcatggtttctgtgagtcaagaaattgaacaaggtagggtagagatagctggtctcttgttatgtaatgtctaaggccttagctggaagactctaaaggttgagggctgaaatcatctgaaaagttgttcatgtctggtggttgatgctggctgtgggctagagacttcagttcatctccatgagttctctccttgagggttagtttgaacttcctcatagcataatagctgatatccaagggcaagcatccccagagagagtaagaacctgttagaatctgtgtcctttttatgctttggcttggaaaccacagagcatcacttcaaccacacttcatgggttggatcaacaacaagtatccttcaatattcaaaggaaaagaacgtaaatccaactcatagattctaccagtcacaacgtaaagtaacataagaagatctgtatattaatctttggaaaatataatatgctatgggaggagtggacacaggtttagctaatgccaggttagggttttattaagtgggacatgaaagcttagagcttgaagtgacgagaaagagggagcagggttggatggggtgagaattttacggactgtggatataaaggggctgcattagtcagttttcacactgctataaagacatacctgagactgggtaatttataaagaaaagagggttaattgacacagttccacagaccttgggaggcctcaggaaacttacaatcatggaggaaggggaagaggcatgtcttacatggtggcaggtgagaggaaaaagagtgaagagtgaagggggaagagccccttagaaaactatcagatctctttagaattcactcactatcacaagagccggatgggggaaactgcccccatgatccagttacttctacctggtctttcccttgacatgaaggggttatggggattataatttaagatgagatttgggtaggggcacaaagcctaatcatatcagggacagagaaaggagaagtgaggaggctgacattatgagatggattttgagggaataacagagatgtttaacggggatatttatggagctttgctgtgtggaatgtgaggtaaaattgtttctctatatttttataatctttagaggaaacatcccactgggttgtagagttggatctatttttggacaaaatacattaagttgctgaatatggcttctatgtagagggagggaaaaagtagaggcctactaaatctaggttacatctgttacatctgctttcagaaaaacttagtaataaatgtggctgtcatgttaacgtttggtggttcctaaatgtcattgcaaagactgaagccagtccatggtaaaattttcattggcaagctctgaaatcagaaattagacatcatgaatctttcacaaagctaaatttgttcaattaaatgaaatgatctttattgtgagtttatatccttccaaactttttagttttaaaatgatcttttttaagaggaaatgatggtgacagtagatagtacttgtgttttggatttttaactgtccatatttggaaaagtaaaaagttactgaccaccatactttagtttctaaaacactggagtgcaatctctaaattgcaatgtgtttggggaaaaaaattcaatccctttgcattaggtatttttattgacattagatataagagaatagtataaatttacctaaatacacagaaaaataatctttactctttataatcccaaagaaatattccttagttcttttttcttctatttactatcaatatctatcacaaaagctgatattacatgaaaatattaatataaatgttacaacattatctttcttacgcaggtttgttgtgaggattaaataaattaatatttatgaagaactttgaatcatgcctagcatgtagtatggactcaaatattgctaataatattgacaattttttttgaaattgctcttcttctgtaacactcaatttatgccattggcataaatgttttgagctagacaagatattgctctattcagagttgccctggaataacttgtttctttaatcataactggtacttttttaacctatttaagctttaaattatccagaaataaaacgaggaaaaaagaagaaattaaaaacagtaataaaaccaatttctcagaaagccaaaagataacaacaaaataaactttaactacaaaagtctttttagagaagaaatattcttatccacctcatagcctagactcagtcaagggaaagggcagccaagaatatcttaagtgatatcctgggctttgttttcttgattcaagtagtgttcacattattataattatatattcttttatctgtatatctgtctattcatccatttattcatttgacaaaaattgagtatctgtgtttgagagacacaaagataaataagatatccacatccctccaggaaaatgtagcatctattttataatacttatgaatattactgaagatctaattataaaataaattaaatcatttatcaaatataaattctattaatatgagtttatatgaccacctataatgataacaagtatgagttccctcttttacttttatctggccttccctcaaaagatagagctaactacctagctactgggctgaaaatactgagttattagcctttgtgcatagtaagctggtggtcttagatcagaggtatatggcttttttccaaagacactgtgagatacgcagaacaaaaatcagaaaactataatcttttaaatgaatcatgaagtaccaaaaatgtaaagatctcttaataaaaataacatttaggatagataccatcagaccagttctgtactctgcctatactattttgaaaatcttccttaaagaagctttaactctgatgtttgaagtggctcatacaatgaaaataggtttaaatgcttattaatcacatgtaaattaaacacataacttttgtgttataatcataaagtggatttgctttgtttcatgtttcttcttaaaataatataaagcaaataaatgaaacaaaaatggaggtgtcctctgctaggtctacagttatataaggaaaaccggaaagataacataaaaatctccctaaatcaggtctatacagaaacagatttgctggatttagagagtagataatgcatgtaatctcaaatataaaatatagcaggtgactttttatggggaagttttttcttaatgttgatagtaacatatctgtacttgacattaattaatccatatcgtaaagatttgaaccagagaatcaggcccacttggtcatagaggcagtcaaggaatgggctctccactacaatttgatgtgaattgtctacttatcatgtctcatagttaaaccagatagtttggtagattctttatcacgtgtgtttctaatacaaccaggaaaacctatcgtatattctttttttttttttttttttttgtgagacggagtcttgctttgtcgcccaggctggagtgcggtggcacgatctcggcttactgcaagctccgcctcccaggttcacgccattctcctgtctcagcctcctgagtagctgggaatacaggcttccgccaccatgcccggctaattatttttgtatttttagtagcgacggggtttcaccgtgatagccaggatggtctcgatttcctgacctcgtgatccacccgccttggcctcccaaagtgctgggattacaggcatgagccaccgcgcccagcctatcatatattcttacattctctctcacacaaatgtgcatgcgcacacacacacatgcacacatatacatcattctgacactgccttaactttcagaatacaaggttgagtcctctgccacatactagcagtataatcctggatgagttacttaaacttactttgcttcagtttgaggatgaaatgagagaatatgtgtaagacatctggcacacatagtgagcattcaataaatgttaactataagtaggtgaccagttggggcccaaggagattgtaacttgcttaaggtcattaaggtagttcgtggctaagtcagaattagaatctacataatgattctcaattcaacctcctttatactaagttatctcactaattggcagctctttcctgtgttaactttctgtacatgaagggtttgccttcccaagtaagttgtaagcatctcaaaggttaaaagcattgtgagtgatatcttcatcaaccataggttctaatagagacttcttgctatttgtaggggttcagcatttatttgttaattatgagctttcaacttcacaatagttaacctgaaattgttttattcatcccatttttctcattctgtcttcagtagttctgtatataagaacagcaagccattatcattctcagcataaaattagaattgcactctgcacaactaccatcctctccctctgtaagtcctcagagaaaatcatacaattttctactatatttctgcagtatgaagaaaataatttaatatacctatgctttggtttctccatatacagaacttatatatggcattactcaatcaccaaagaattccattataatttagcttattgttatgtaaattcaggcataacccaggccacaatatgatcccaagaatataacaagtatccatagggaaaacctggtagaataactcaagagtgggaattatttttagctttggatgacttttatataaaggagctccactcacaatacattagtggcactattaactacactcgctagtaagctaatatttgaggtccattttttacatctctttgagagtatatcagtatatcaagcattacaaattactaccttgattgcctttggagctactctttttttgagacagagtcttgctctgtcacccaggctggagtgcagtggcaccatctcagctcactgcaacctccacctcttgggttcaagtgattctcctgcctcagcctcctgagtagctgggattataggcgtgcaccaccatgctcagctaatttttgtatttttagtagagacagggtgtcactatgttggtcaggctgttcttgaacttctgaccttgtgatccacctgcctcggcctcccaaagtgctgggattacaggcatgggccaccgtgcctggcccttaagagccaacctagcatatccttgtaaatcagttgcctaaacaagcttcctcttaaatatgcctttgaaaaatataaattcctctctatcagtatctacatttcactttgaagatcttatcggctttcagcagcaggtgtgcatatcctacaagtttcagttttctcttgatgctcaggatgaactaaacatctagacaagggagcatctgggaagtctgactaactggactacttggactggtttgtcctcacaaaatgtaagacttacaatctgtaggctgttacctagctcctgagagctacctcccccgggccgcccacactagatttttagtcctgagctgcatacccaggaattctcctgtttccgtgaatcaggaaggatatggcaagttaagagagaaggaaagaacctgctgagccttgccttccaagggatatcaggaagttactcaaaagacggcaaagtgctctctacacaaaagtgctggaagaactgcagttatattccctttaggaaaggaaactttaagatgatttggaaatagccaaatgtaatcacataacaaccaattttgaagtttgctggcatgcaacactcctttaggaattcttggtttccagcttggtctcattggcaacaaatagaatttcctaagccttattaggagcctgacattttgtttgagaatcaaaacttttctgtttgaaaactagagccaaactcagttatataaaaacagggatgtaagagaaagagcaaacaaggaaagctattatgttatatgtgtgcagaacataatagtttgaagagggagacttctcgatggaccagaataaatactagaatgtaatacacaactcggttatacaaggtaaaaatgagttactggcccttcaggatgggtatcatgatagctcattaatttaaataactcctaatatgcgtgtagcagtttatcagttagagagtgctttacatgggttgcttttcacaatagataacttagggcaagtgaaggcctgggtctgaaaacatattctgcaaaataagcccctcactgttaaaacctggcaaatgctaaggactccacagctagagcaaatggcttctatagttgaataatctttcaataaagttagaaaaatgggtgtccttcttcaatgcatagcatgttgggaacccaggatactttagaaagtctcttggtccagcactccgacttgtgaaagacaaatattgtcatacaatgctttggctgatctcttatttcttgtcaacctaaggtacagtgggtattaaactcttttagcttcctgaagacaaactaattcccgacctccctgtaataattgctgaacatgggaagttttggggtctgagttttaattccaagtaattcattatgtctgtcattgtctgtggtaggttgcttgcccaccactttgccagtatcattatctgtgacttgaggcaaatggtaaggacagcttgtctgagtctcagcacttgggtggcagatgtgacagagatagataaattggccagagtgagtattttaaaccagaatactgcccccaagcccagtatgggaccatctacagtatggaaggcagctcagacataggtcagtttgttcaggagaccacacattatgatctgttgagctgttcatcattttcacttgaaaatgaggggtggctgtttttaggctgtcagcctcagatttgaattctatagtgattaggtggtgaaatggctgctctctgcagactgctcaggggctgttagagctacacaattgccctaaaatcaacaggagcaaatagcctcaccaaaccagccttgagtcattcctttaagtgagggtgattaggagggtcagctatttttaagaaagaaattcaataatcagtctgtccagagactcaaaattatttatcatggcattttccaatgtcacctttcctcaccatcactttgttggcattaggctttgagacatggttctcaccagcaagatggttatttttatgtcttatcaaggtctctaacaggtcctatgacacgcaaatgttagaaaggagaataaagcaacaattgagtaaagcaatagtacagtgggaagagagacaggaagatgatgttgccatgttttagtttaatataaattgttaatatctttgtctcagtcactgtatagaaataaaatattttcagattaaaagatcctagatcttcattgaatcctacctctcttaacctcagcccttttggaaaacagcacaaactccaaactgtaattcaagctctaaaataaaaggctgggctggatccaaagtgttttcaatatttttctggtagatttttactggtttttcatgaaaagcacttaattcaaatattattcttccatcttttaatgttttagtcaacagtaaatgatactctcttctgatatactcctctcaaagtggtagaagagtttgtggcaaattgccatttcaaccatttattctgctccaataatgcagtattgaatacactgaagcacggaaaaattaactaaactacttttatgcactttcaaaagaagcaacagaaaaacttggcaaagtaataatagtgaaattttattgcttctcaatagattaatatacttaataatatcctagaaaatgctgcactttgaaattttaacatgtaacagtgtatatcttaaattaaaaataactgtatagtccagggtggttatttatactttatatagtctatattctttgtgagatttgggtttaaacacatcagagtttaaattctgcgaagactgcagagtaaagaagattaagatggagggaaggaggaagagcaggaagagggaaagtaggtatagaggaagaagagaaaaggagatagtagaaaggggaaaggaagatggcagggaggaaggagaaatacctcaagtccatgaggggttagtgctgaaggataccttcatcattaagtaaagggtgaattgcactgggttgtttaaaagcatgcccagatactgctgggtgcggtggctcacgcctgtaatcccagcactttgggaggccaaggtgggcagatcatgaggtcaggagatcgagaccattgtggctaacacggtgaaaccctgtctctactaaaaatacaaaaaattagccgggcgtggtggtgggggcgtgtaatcccagctactcgggaggtgaggcaggagaatggcgtcaaccccggaggcggagcttgcagttagccgagatggcgccactgcactacagactgggcgacagagcgagactccgtctcaaaacaacaaacaaacaaacgaacaaaaacaaaaaaaaagcatgcccagatacaatcctaaagtatgcccagatacaatcctaatgcaaaattttatcagatggaaaagtatcaaaagctggaataaatagaaaaaggagttcatgaaatgtattcaaagaaattttaaaaatagctcaggtacagaatctgttaaagcaacaaagcagacacatgactcttcttaatcttccacacttgactccacggcattaagttaacacttccttagtctcctctgagttgagacaaatttcctgaaaggaaggttgacattccctggacactttaaggatctgtttgtgcctcatgggtataggttgtaaaagttctttgcatagatatgtcagcattttagtgcattgtttggctccaagtgacctttcctccctgcatttcctcatttgccattcatcttcttgcttcccttcgtctgccataatagtccctggggtatagtataagtgcttctagggcactcctctaactgcacggttattgttactgcacaattaaaggacttagatattgaaaaatggtagtgtttggaattctgcaatctcattccttaggggcagggaacaattggaacacctaaaaaagggtcagagtccagaaccagattcaggagagagttcagctttcaattgggttggtccatttttcagtgctgcccgcacgagctgtcagttgctggaactgcagagtatttcaaggaaaggcgcggctaagcagaggtgaaatctttagacagatgagtctcaaagaggaaattatgcagaagccaaatggctacaaatggtactgaggattgaaacctaaactataagtgaaggtctcttccctaaatgatacactcagacttaacaataagctaataaggtggttcaataaagaaaatgtgggtctgatggaagagtagagagtttagaaggtgagtaagagatatctatgatattagcttgggtgtgtttttggtattgatgccattgtgttgggagtacagcagaaggacaaagaactcctttagcaacttggcctgcagtcaaataggccaacattggaatctgagctccactgccttcttcacctgggactaatcacttaccctctcagtctcctcatctgtaaaaaaaaaaggataataataataataattgttacctttggaaaattacacctttctcttctgtacctttaacctttctctcaactagatactttccatgagactcaaaatacattcaagtgtcttctgcattaaaaacaaacaaaacaaaaacctcaccttcaaccacttatttccctatgttagggtttctcttgacgtttggggctagataattctttactttggggctgttctgtgcgttttgggatatttagcagcattctttacccatgaaaatattgtgtccctcgccccacaagttgtggcaatcaaagttgtctctagacattgccaaatatctcctggaaagatgcccaccccccaccccagttaggaaccactattctaatgactgcctcatctcttgtctcccttgcaaagccacacttgcccagttttgcctattctctctagctatattcctcacttccctatcacagccgatcctattctagtctgtctcttgttcccattttaccaataaaatcatttttagtaagaagaacaataacctggatagttctaaatgtaatgaatattgcaattcttctcttccttgatttctcacaatttgaagtgtgttcttctcctggctcctctgacactattctctctcggcttgatctgtgaagcctgggtctcctggaatagctgcagcctttctctccactttcttaccatattctctcactgtgtccaggacactagctcagactttttcaaatgctgattaaagggcttccatgctgacagagggcaaacctcacagagcaagcttttcttaagcttttgcttatatcacatttgctagcactctcttggccaatgcccagagtcacatgggaagagcctactgaaggcagaaatacagagagagaagacttttggcataacatcttgagggcttcctttaacccactccccagtaaaactagtgaaaactatgatcaaacaaataaaaactccaagcacttaaatcctctggaaatgatcctaaggacaaatagcaaatgaagaaacatctattcaagaacatttatgaaaattcaataagaaaggcaagcctgtggtatttaaaccaagactgctccctctcacccccttccaagttcagggagatggagcttccattccaggctggtgcaatcaagaacacagagctctctcccctccagctggaaggtttcttcctggaaggaacagaacttcagtgtttctcatcctggccatagttacccattgctaaggctaagctctggtgaatacagtagagaggtaggggcttcctcccctgccaaatcccccatcattgaatggaggggataccttaggcactgcatgctaagaatacagaggcctcatcatccttgcctggcctcctgaggtgggggttccacaccaggagagataaatatagaagatattagagtgctgccacctcccaactaagctaagctcctagagtgggagtttcatgcagtcatgcaggaagaacctctccattttctccacctccatcttgagaaacatggcttagagattttgcctggtggtggcgggggcaataatccatcataaaataaatattcttaatctcttcccaaagggcatggcttcatttgcaacaaagtatggaaaagttcaagccttagagtgcgctcaagaacagtggaagctatggtgaaaggcaattgggaggagagtcaagatacaggctaaattgcagactagtttgcaggagagaaccagagaaataacacagctgggaggagccctgacttcgaactatttcttcaaaggagacacaattcgattgtattagtgtgttgaacaatataaggttgtaaagcactgttgaaaataacacagcaattgttcaccaattagtggagttgaacagctgaatgtggttaaggaaagagtgaaggacaatcacacgaacatcactctcatgccggctgggctgtctgtggacatacccaaagatgtacctccctgatagcaaactcagtgacttaactgagggaaattaactcacctgactgtgaaggaaatatacttattaaaataatccagcccctcactaaacaaccaaagaataatagcaagccctgggtggtggtagggggagtaagaagagttgctacagtatattatctgcaatatccactttccaaccaaagatcacaaagcatggaaagaaacaaaaaatataacccatacacaggataaaagaaccagatggcagaaactatgggtgagagggacccagatgttggatttaatagagagatggagaggagaatgaatgcagccagtgtgcaatgtgtcatgtcctctaaatgttcaagtccctcaagtcatagatccacctattttttctcaagttaatatctctacacctagttttaattccctgtcatgtatacaggactcacacattttatcttcaacttaggccttccctctgagctccggacctgtgtatcattcagcctttttgaaatctctatccatatgtctcaaaggcacttttgattaaatactaccaaaaattaactccctctatctcccagtgttctctatttcagtgaatgataccatcaaacatctactttcaaaatcaaaactctgagataaatctctaacagctccctgcttatcaccccaccccatcatattgaaaaccaaacccatttaaatacctttcgtttgtgtcctcctctctctacctccaccaccagtactgtagtgtaatctgccatcatctctcacatggattactgcacaagtctcctatctggtgcccaaattaggagcaccctcctaactggtatccaatctaatctctacactgtagccagaaaaaatcctttgaaattcaaatctaatcatggtatgtgcctcccccttcttctatggagaccataggaaagaaaccgaaactcctgtggtgcttgagttgatgctagtaacctctaaacctcatttcatgcctggatctgtcacttcctgaagctccatgataaagcacagcctcctcaccctccaagtgcgggggttctctagttgtctcttccaggtgccaccagagggacttctctcataaaaggcctgtgcaccctatgctctttctctctctgttatggacttccttccagagagctggtccccattccttgatatgggactgtccacttgtatgagtaataaaaatccttctctgatcataccaaagaattggtgtcatgagtttttatattagaagctaaacttgagagggaacttccccatgtcacagtgaaggtgtgatgataccctctttctaccatctttaaattcttccgtcgcttccattccattttctcttaggataaagttcacaatccttaggttggcctacaaggtcctctacagttaggtacccccgtctgctttccttccttccttcacattagttatgctccccactgcctgaaaacatgcagacctgctgcatcctctacctgaaatactcttctcctcacccctgccagactttacctaatttgcccttcgtttgtctttgtaacaccgctcagaaatctcttcctcagaaaggccttctctgacacctcagcacagtcctcctcacgaggtcagatgtattttttcttcaaggcactgactttggtttaaaatttgtatttattcatgtaattatttggagtgcatttatcttcctcactagatataatcaccattagctcaagggctttatatgttttgcttgccattgtgtcctcagtgcctaggccattcactgacccacagtaggtgctctgataaatatttgttgagtgtagaataaatgaagacccttagaagcataaaatatataatctcaaagcagaagatactttagttagaataagttaggttcaactatattaacactccttactacacacacacatagctacactcatcaattttggtggcttacaccaaaaaggcttatttcttgtgcacactgcattcttgtgctttaacaggatactccgccctacctcatctttattacagaccttggctgacggaggctaccacttggaatattgtctattttcaaagtccagcagaagagaagttaagaagggtttcactctggcaattaaatattccagctaggaaatgacatactttatcttcatatacaatccattggccataactagtctcatggtcctgcccatttgtaaaggggaaataggtaatcatctcatgcattgaggaggaaagaagaattagatacatgtgaccagtagaagtctccttactgacattttaatgtagagctgtatgtgattaaagttaaaattgaatctgaagggctgacagaaaaattcaagaggatatgatatttaataattgaacgaggctgaaagatgaaatttggacagattgaatgggtaggccttgctagcaggaaagacaaaataaacataatcaagaagtatgtatgaacgtgtgcccagggcagtgaggagtgatcagcctccttgaagtggaggatgtgtgtcaaggaaccagaggagatgattagagtggcagacctgattattagcatatccatgcttctgtctgaagcctttttggcctataatgtagaaatatccttggagtaagcagttcagcatatggttttagacatataggtcatcttggctggattgcatattcttcatttttaaaattccaggctgtattggttgatatgcagtccagaaagagctggatctgacttaagaaaataaaaactgctttaatccctcttttcagcccattgtctatccattagcaggtaaacaccagtgtccctgcaagtgtgtgaactgagcttccttaatttcacctttaattggcacttctagtgacttaactgagtgaagagacccttagcaatgatacaaagtgaaggatggtatagaataataggttttctgaaaacctgaatgcaattgaagggtgctatttaataaatctgtccctagaagctaatagcacgtagtcaatacaatttagcctattttctcccatgttacatttgttagttgtactggttttggaaaaggaaaagtcatgctgttacagttccactaatagaaaacagataatttgggaggaaattagattggaataaaagcacgttgttaaacaagaaatcacaataaagtattgagtagagagaaaccgttaatggagacagctatgtcatacctaatatgccctcttttcattgatccttagaggaagcataagatcgcagctaagtatggtctcttgagccagcctgccatgattcaaattgaaactccatcattcaccactgtgtgaccttgagaaagttatgtaatcattcttggatagtgattcttactgctatggacagatttgtgttccccccaaattcaaatgttgaggcaactgtgtgaggagagagggcctttaggaggtaaagttaaatgaagtcataaatgtagggtcttaattcaataggattagtggccttataagaaggggaagagttttctctttttctttctctacttgcctgcaccagggaaagtccttgtgaggacacagtgagaaggtagctatctgcaaactggaaaagagtcttcaccagaacctgaccatgctgacacacagatctcagacttgcagcctctagaactgtgagaaaataaatgttgtttaactacccattctatggtattttgttatgacaacctaagctgactaatacactcacctataaagcagggataataacagtgcctatatgatagtgtgtttacaaggatttaatatatgttagtttatattattttatgtccatatatgttagcgtatatattattttatgtctatctctaattcctcattgaggatacttaagaattctactttccatgtttgacagacctggtttggatttcagttccacctcttgtaaactctattaccttgagccagtgactaatgtatctaagcctccattttcctatctgtaaatggggatgataactagtgctgcttgtctcttcaggttgttgtgaggattaaaggagatatgcatgacaattcatctgccaggtagtaagcattccaaatatgctatttactgccatcattagaggtttgctgagcttcctcttttgcattaagtaagagactattctctccagaaaactttgaactacatgatggaggaacaaataatagcagtttctcctcaaccttggaactctaaaaatgttttttctaagccattcttatctttattttgtcattaaaagatacatgcattgtgcattttgcttttatttaatatatgccatgagtgtctttctccctatcatgatgtcaatgttacattacagattctaaggagcaggggccatatcccttaaacatgatttatttaaaataacaatataggattggatgtgactactgcttttgcaatgaaactgaaagatgggagagtgagatttttctcacagctatggagtggcagacctgagcactaaaatccagtctcagaacccagttattatctcacaatgtgaaggcaggaatctatagacagattattgaacatctcatgtatcatatcatgtatatcattaagcttatatgtatgacaaaatagtattttgtgcagcagtgcttctcaaacattaataaatgaatcacctgaggatcacattaaaattcagatgctgatcagggagtctagaatgggactgaagtgctgcatttcttttctttttttttagactttaagttttagggtacatgtgcacaacatgcaggttagttacatatgtatacacgtgccacgttggtgtgctgcacccattaactcgtcatttaacattaggtatatctcctaatgctatccctcccccttccccctaccccacaacaggccccggtgtgtaatgttccccttcccgtgtccatgtgttctcattgttcaattcccacctatgagtgagaacatgcggtgtttggttttttgtccttgcgatagtttgctgagaatgatggtttacaccgttggtgggactgtaaactagttcaaccatcatggaagtcagtgtggcaattcctcagggatctagaactagaaataccatttgacccagccattctgttactgggtatatacccaaaggattataaaacatgctgctataaagacacatgcacaggtatgtttattgtggcactattcacaatagcaaagacttggaaccaacccaaatgtccaccaatgatagactggattaagaaaatgtggcacatatacaccatggaatactatgcagccataaaaaatgatgagttcatgtcctttgtagggacatggatgaagtgctgcatttctaacaagctcctaaacgatgctaaatctgctggtcctcagactactctttaagtaacaaggatatagttggttttagcaatagtgacttaaagattttttgctatttttgtttttatctacccatttttgtattcactaaaatgtgttctggatgcaaacttctttaatacaaagggaaaataaattaaaagccaactttgcaagaattgaattacacacattttaaacttaaaatgcttcggttcatttctctgtatgttgtgtattcctaaatcattcacaatgtctttattttttaccccttttttatcaaatgaggaagtagtactcctctgacttttttcagtttttatcttccataacacattaaatcacctcaaccttcctaaaaagctctccttgttttctgacttttactgtcttgagtctccatttctcaacccctaagtcatgcccaaatcctgttctctgacattttctcatctctcttactttcttctccttgggaactcccatccactgccacatattcaaacattaaattcagctctctatacacttctgcatcagtgtctttcattccaaagtcttttctaagttttattcttctatgcccaatggattggatacttatgacctcacagccctttaaactcaacatgtcaaaaaccagaattcatatacttcttactgttaggccccaagccatctgcccacaaccaccaggttatattgttccctttatcaaaattttcagtgattatatttacggtggaataaatttttaactctttattctgacattgaaaattgtcgtctctccaacttcaatatttttttgtacctatatcttccattgcttttaaatatgtggttgacttaagtttgcctgaatcctgtttccagaatgtgcctggaaactcccaacctccatgccatttcactctgaatctaaagatctcgtaccaatctttgcttattcaaatgttgcatatcttttaaggcctacacgaaatgctacaacttttgtggtatattctctaatcccttacctgaaagtgattggtccctcctctgcactgctataatgcatattctttgctatttagaagacagcccatgctgcactatatattatagatctatgcaaatatctgccactatctgaaacttcaaggctccatctcttctccattattcctccaaacaccactcacagcaggttgttgtcagtaataaaattttattgaaagttttggggattatgcagggcaattatagcagaagcaggaatcaactggaattagagtgatagaaccacagcccttagacatgtatcagacactccctgaccaagtctgtccatggacacagaactcctcacctccagatacttcctcttgcatctcttctaccagtatcataaccctcacaaaaatgacaaaactcaatgccttttacttcgttatgcagtaatttcccctcttttgttactgtttaaactttccagcgctttgagaggccaaggtgggcggatcacctgaagtcaagagtttgagaccagcctggccaacatggtaaaaccctgtctctactaaaaatacaaaaattagccaggtatggtggccagtgcctggaggctggggcaggagaatcgtttgagcctgggaggcggaagttgcagtgagctgagatggtaccactgcactccagcctggaggatagattgagactctgtctcaaaaaaaataaaaagaaaaagaaaaccctcaccttctataatcaaataggtttttaagtgttttcctaagcttgatagcacttcagtctctcagaggaattctgcagtcctgcagttgtcttgggtcaaccagccaaaagttaactaatttgcataatggcagccccataaaatgcgcaaaattattatcttttatatgaatgcttattaatatatatatatatatatatctccttttacatctatctagaaaacgttttaagggaagaatcatatagcttcaaacatttttgttaattacaatatggaagaaaagagagttcaattccttaatctatcatgtgtgagttaggggactttaagcaagttattttcttaggaatcctgtttcctgacctatcaaatgaatgtaagaatagctacctcacataagtgtgaggacatagataatttctataaaatcatttagttagagtcttggcacatagtaggagccctgctctcagtacaagtttaaaatgtctgttgaatgctaaaagattactccattgagctttttcaaactttaaagtgagtatagtgtttcactgtaggattccaaaagctgtttgatgctatgatttctttctcaacatcatgtttactctgaagacatttccatagtgttctacccttaattgaacagagataggaaatcacgactttaaaactttcagcgttaagagtaaatgacacattagtttagagacatatcaataattatggaagtatcttctcaaactgtaatgttttcctctgccttagtgctagcaatcaaatccactgaattaatctgagcagggtcaggactttgaacctgaggaaaatcacttgaatttgaggcattaagtgtgcagtacaaggtgttccagctacaaattttctgaatcctatttcaaagcaatggtgcaggagaccagatagccacctcaaaacttctgagtcccatagtgttttggtatggctccagaagcctgttgctgccccagaaaagggagatttcaccatttctaaagggttagctgctccctggggatgacagataggtggcaaaaattggaatgtagaaattttccttatgttctaaaattgcacagaaattttctagggaaatattctttatagatttcccaattttgttgactaatctcttcatctgaaatgtttccctccatgtatgaattttctctctgtctttctaagtccagtgtagaatcgatttggtatctaccgactttccagattcctccaagttgggataaatcatcatttcctcctctgtgttcctagtgcatagaaataaaatcatttatcacaatctttggttactgatgatggtggggaggtctttacagtgtgatggcttgaagtacaaagtacaaacttgaaagtcagattaccacttactttggaccttaggcaggttacttaaccccactctgcctcagtttcctcacctgaggacttaataatagtagctaagcaaatgaacttactaatagtagctactttatgatttttattaggattaaatgtaatggtgcatatgaaattagtaaacaagagttgcaaagtagaaaactgtcagtgaatgtcagctctctctattatccctcagagactcctcctgccactttaggtagaaagctccttaataattgtgaccataacatgtttatttctttgttggtatagtcagtgctcaatacattatctgttgagttgaactgcatttttgacaggagacaacttaagttataaaaatcctattttctatttatactatcataaaagtcgtgatggctatgcttttaacacttgacctacctgaatgtggatggtttctaaaagtaaaataccttttaatgctgtttagagtgtatggcaggatcagaaaggcatatgtgccatggcttgaatatttgtcttctctaaaactcatgttaagatttaatccatggccgcgccccacagtggctcaggcctgtaatcccagcactttgggaggccaaggcgggcagattacgaggtcaggagatcaagaccatcctggctaacacggtgaaaccccatctctgctaaaatcacaaaaaattagccgggtatggtggcaggtgcctgtagtcctagctactcaggaggctgaggcaggagaatggtgtgaacctgggaggcggagcttgcagtgagctgagattgcaccactgcactccagcctgggcgacagagtgagactccgtctcaaaaaagaaaaaaaaaaaaaaaaaagaagaagaagaaaagtgtcagtatagagaagtgagacctttaagaggtgattgggtcatgagggttctgctctcaagaatagattaattgatttctggattaataggttttcatgggattgggactggaaggagaggaagagagacctgagctggcatgctcagtccccttgccatgtgaaaccttgtgccaactttggactctgtggagggtccccaccagcaagaaggtgctcaccagatgcagccccttgaccttagatttcttagcctccgtaactgtaagaaagtttcaggtattctgttataagcaacagaaaatggactaggcagcatgtaaaccaaattaatcaacatacacaaatttttgtagcactattttactcttttatataacaaataaagccttaaaacaaatactattttgaaagaaacttacatgaaatggtcataagcataatttaaactttaaaattacatatgtaaagttttcattgtccaaacatgttgatagacaaaatggaaaagataaatagtttgtacagttctctcttcttgaaaagtattgctttgattaaaattcatattgtcccaacattgtttaattcataaatagtaaaataaatatggaacatttttttcaatgcagtatttgttttccttgaaagctttcaaaagggagagacaagaatccccagaatattagaaatctttcatatttttattacaatcactgtaatcctgaatatttttttctagcttgaagcctaaaattaccagtactttaatatacaagatgaaagtttgtttactcataccactgcatattattgtttgaaacaatcatttctggcaatagtcatacctctgcgtattattgtttcaaacaatcatttctttcaatgactctaaataaaaaattcctgcttctctttaaaaagacagtgggaataagtttctctccttgagcaatggggcccctactctgcctggttttcttcccctttcttagcacagacaccactggaagagctgagccctcatttaagattgattctatattagtttcctaaggattctttaacaaatgactgtaagctgggtggtttaaaacaacagaaatttattctctcacagctctggaggtcagaagcctaaaatcaaggtgttagcaggacttgttggttctggagactttaggaaagagtcctttccttgcctctctccttgcttctgttgattccaggcattccttaacttgtggcatcataactccaatctgagttgatggaagtagagatctccatcagtacatggtctttttctctctctgattctcttcacttcttctgttctcttctaagggcacttatcattggatttaaactccaccctaatccaggatgatttcaccttgagatccttaattgaattacatctgcaaagatcctttttccaaataagttcacatttacaggttccagatggacatatatgttatggggccggtttttttttttttttttttttttggagacggagtctcgctctgttgcccagactggaagtgcagtggcacgatctcggctcactgcaagctccgcctcccgggttcacgccattctcctgcctcagcctcccgagtagctgggactacaggcgatggggccgatttttaatccactaacaggtaccttgagactagggctcactatactttggtcagagatgctctaggcatgaagattatatttgcatgaagctaacattttttcaagactacgtgattgcactgctcaaacttacattatggtttccagagacagctagagcttccttgttcattaactttgaaaggaagcattttccctgggaagaggtgcccaagcctcttttgtaaggtgggcttgtcttaggcagtaactaagcctagagtcaggtctactaataatccattaagatgctgtgttagaaaaatcctctccaaatatgatggaaataagtatgtataagaagtatttcacagatgaacacattcccactttattaaccaagtgcctgtgtgcttgcttaaatttttcacattttcagacacttaacatattatagaaaataacatccaaagagaacatgatgtttagctttttggattctttgggataaagagcaaaccaattttgaattaaaaaaaaaaagactgtagataccacatccttaaataactcaaaagttttgtaccaaaggctactttttaaagttgaatcaaaatgaaataggtgtgaacacctatgttttgagaggcagagaaattggtttttttaaaaaagtgggaataagtgagtattttttaaaattgaaaagggtgtagattgggttcctcagagattgctaaagctgatatcataaattacctaaggacagggagaatgaagtgaattgtgtaaatgtctacaatattatacttttcttgcttatactaagctaaactagtatggatgacatgtagtaaaagttataaaaggaaattcatcttcacctgtgtacatgcaaaactgctgcatttgcagattaagtcaaaattatatatagagagagacacacacacacataacacacacacacatatattgaaaatctttaagtacatctaattttttatgactcagaaaagaatccttatttaagccctttttactacagcaaaaaatgttaatgtccattaaattaatggactttgctctgatttggggatgataattgcagaaatgagtagggatatatatatgatctaatatatagaaatggatatatagaatatatatgtatatagaatatatagaaatttctaatatatagaaatttctaatatatagaaatggagcattttaaggtctggaactttggggctgtcaacagttataagaaaatataaagagagatatatacagagagagtaataacaggtagtcccaggagtaggacaggagattagtggcccagaatcaataccatatttgttctatttcatctttttgcaagacaaaatagatacccagggggctggggaaggtgaccagtaagttacttccattattttctttttctttttcttttttttgagatggagtctcactgtgttgcccaggctggagtgcagaggcacaatctcggctcactgcgacctccaccgcctgggttcaagtgattctcctgtctcagccccccgactagctgggattataggcgcgcaccaccacacctggctaatttttgtattttcggtagagacggtgtctcaggatgttggccaggctggtctcaaactcctgacctcaggtcatctgcccacctcagcctcccctattactttcttcctttatccttttctactgtttaaaagctcaaaacttgttgaaactccctctccatcagattctgtgtgcccaaagaactgtccttggaggagagtttcaaatgtctttcattttaatgtctggccttggtgattgtttaagaagtcccctgaatgaatttttgggtgaactcggggcctagactggctcaggaaatctggcactgagccccatatttactttggccaaacacaatacttgctgtgcagccacattcactatgcactgctcacaccacgcagcttgagagctttgtccctgattcaaatctgctgggtattattcagtctgaaaatttacttttacaccaagcatataaacaaaatgaaatacagtttaagaaatcagctcataacatttacaattaaattcattaatcaaggcagcttatggaaatgccacatgtgaactgtaaactttataaatattcaagtagtgaacaactagacaatcacattggcagctttgtttcagtataagtgatgtagaatattaccatccatcagcttgcagttttgttttaaaacttgttgaaccatgtatatcatcaaaaagaacttttggttacatttctgtttccatatgtttcccatttaccttcctctctagatttatgtgccttcgtactaattagcacctgcactgaattcagaaagcagcacttgaatcaaaccaagtcaagctgtctgtgaaggaaaaaaataccaagttccaagatttcttgttaatggagatgaacagtacactttgttgatgttcttattcacatgtgtcttcttaaagtatgagaatttagtatatgttctttcagtatatgcaaatatatccacatgggtattttcaaactatgctgcagtgtgctttgtctggttaccagtttttattctagtacaagaatgcaggatgttattcgtcacattcacactatattaatttaacctcctaggtctgggaggagagaggaggaaaattaaaggaggcccaagctttgcatttgagagaaaaagtgaactgggtcttgaaagatgtcttaagaaacaaaagagagaaagaaaatagaggaaatgttagaagttgaggtaaaagtgtgtcatggagtaaagaagagcatggagagaatactattagtcaagagaaactgcagctcaaacactcaaatgcagaagcatcataaacaagctaaattccactcttcctttagttcatgtgttttggtctatgtaagctgaagacaaactctcctttttccatgctcccatacctcatagaatgtgtttggaagtattctctcctcttctatttttcagaataaattgggaaaattggtattacttctttaaatgtttggtaaaatgcagcagtgaggccatcagatcctgggcttttctttgctgggagactgtttattattactttgatctcattacttactattggtctatttggattttggacttcatggttcaatcttggtaggttgtatgtgtctaggaatttattcatttcttctagcttttccaatttactgccatgtagttgcttatagtagcctctaatgatacttctaatttcagcagtatcagttgtaatgtacccttcttcatctctgattttatttatttgtgtcttcttattaagatgctatgttagaaaaatcctgtcagagtctggctaaaggtttgtcaattttgtttatcttttcaaaaaatcaactttttatttcactgatcctttgtattgttttcttcatttcaatttcatttacttctgcactgatcttgatcattccttttcttctgctcgtttttggtttggtttgatcttgcttttctagttctttcaggtgcatcattagggttttttgtttttgaagtttttcttctttttttgatatagggtataaactgccctcttattactgcttgcaactgtacccgttaggttttggtatgtttctgtttccataaccatttgtttcaagaaatgtttcaatttccttaatttcctcattgactcactgctcattcaggagcatattgtttaatttctatgtgtttgtttagtttccaaaattcctcttattgatttctagttttgttctattgtggtcagagaagatactttctattatttcaattttttttaatgttttaagacttattttgtggcctaacatgtggtctatccttaagactgattcatgtgctgaggaaaaaaatatgtattctgcagccattgatgaaatcttctgtaaatatctattagttccatttggtctatcatgctgatcaagtccgatgtttctttgttgaactcctgtctaaatgatgtgtccaatgctgaaagtggagtgttgaactctccagctattattgtattggggtctacctctctctctagctctaataatatttgctttatatatgtggatgctctagtgttgagtgcatatatatttacaattcttatatcttcttgctgaattgacccttttatccttatatagtgaccatgtagtctctttttatagtttttgtcctgaaatttattttgtctgatataactgtaactattcctgttcttttttggtttccatttacgtggaatatatttatctatccctttattttcagtacatgtgtgtctttatcagcgaagtgcatttcttgtaggcaacagattgttgggtcctgttgttttatccattcaactactctgtgtatttactggggagtttagtccattgatattcaatattagcattggtaagaaagaacttactctgccattttgttgttttctggttgctttgttttcttctttcttctttccttccttcctgtcttcattttagtaaaggtgattttctctgctagtatgtttttaatttcttgaattttattttttgtgtatcagttgtatgttttttgatttgaggttactacaaggtttagaaatatcatatcataactgattattttaagctgacgacaaattaaaactgattgcataaacaaacagacaaggaaagagaaaagtaataattttacacttttactttgtcctcctactttctactttttaactttcattgtttcttttttttttgagatgcagtctcgctctgttgcccaggctggagtgcagtggcgtgatcttggctcactgcaagctctgcctcctgggttcacgccattctcctgcctcagcctcctgagtagctgggactacaggcgcccaccaccacacccagctaattttttgtatttttagtagagacggggtttcaccatgttagccaggatggtctcaatctcctgacctcgtgatctgcccgcttcagcctcccaaagtgctgggattagagacatgagccactatgcctggctgtagttattatttttgattggtttgtcttttagtctttctactcaagatattagtagtttaaacatcgcaattataatgttatactatcctgcgtttctctgcatatttactatcatcagtgagttttgtatttttaattgattcttattgctcattaatgtccttttcttaagaaatccctttagcatttcttataggacaggtctgttgttgatgacatatcaacttttgcttgtctcagaaagtctttatatctccatgcatgaaggatatttttgctggatatactattctagaataagaggtgagatcttttttttttttttttccacactttgtgtatgtcataccactctctgctgtcagacattttggagcgccactatatattatttgtttattttctcctgttgcttttagagtcctttctttatctttgacctttgggagtttgattattaaatgccttgaggtagtcttctttgggttaaatctgcttggtgttctataaccttcttgtacttgaatattgatataattccctagctttgggaagttctctgttattatccctttgaatacactttttatccctatgtctctctccaccttctctttagggccaataactcttagatttgcccttcagaggctattttctagatcttgagcttgtgtttcatttttgtttgtttgtttttctttcttttgtctcttctgactgtgtactttcaaataacctgtctttaagctcactaattctgttttctccttgataattctgccattaagagactctgatgcatgtaaattacacttttcaactacagaatttctgcctgattctttttatttcaatctatttgttaaatttatctgatagcattctgacttctttctctgtattatcttgagtttcactgagttttctcaaaacagctattttgaattttctgtttgagaggacacatctctgtctttccaggattggtcactggagccttatttaatttgtttggtgagatcacgttttccttggtggtcttgatgcttgtgcgtgttcatcagtgtctgggcgttgaagagttaagtatttagtgtagtctttgcagcctgggcttgtttgtacctgcctttcttgggatggttttccaggttttcaaagagacttggatattgtgatctaagtttttgttcactgcagctatgtctgcattagggggcaccccaagaccagtaatgccatggctcttgctgacccatggaggtgtccccgcttggtgttcttgaataagatccagaagaattctctggattactaggcagagattcttgtcctcttcttttactttctaccaaacaaatggggtctgtctctctctctgtcttgagctacctggagcttggggaggggtgacactagcacccttgtggccaccaccactgggatggcgctgggtcagacctgaagccaacacagcattggatctctctcaaggcctgcaatgaccagtacctggctactgcatatgtttgctcaaggtcctaaggctctacaatcagcaggtagcatagccaacaaggcttgtatctgtcccttcaggacatcaagttcccctttgccctaggagaatccagagatgccatatgggagccaggacctgaagtgagaaatcttaagaagctacctggtgttctattttacgtgactgacctggcaccaaagctataagacaaagacctccccgttcttccctcccttttctaaaagcagaggagactttccctgaggctaccaccaccctagacctatggcaagtgctgcctggctactgccagtgtttactcaagatccagtagctcttcagtcagcttgtggtaagtgaaaccaggcctgagattctcccttcagagcagtgggctacccttttgctgagggcaggttcataactgctgtccgagagccagggcctggaatgggagatcccaagggcctgcttggtactctaccctactgtggctgagctggagcctaagctaaaagacaaagtcctctttacccttctttctccttttctcaagcagaagcagtcttttcccataactactacagctgggaatgttctgggtcacacctgaagccagcatttctcagtctcaccccaggcccacagtgagtaccacctggctattgctgctgattattcaggggccaagggctctttagtcagcagatgatgaatgctgccaggactgcttccttcccttcaaggcagcaggttcccttttggtccagggtatttctaaaaatgtcatccaggaggtaaggcctgtaatggtgggctcatgactctgccttttgccctatcctaccatggataagctggtatccaaattgcaagacaaaggcctctactcttccctctcctctccttaggtggagggaaggagtctcacctgcagctgcaagctgctctgcctagggttgggggtggggtggcacaagcactcctttggctgcccctgctagtgtctcactaggtcacatgtcccccataaacactaattctaaacccatcccagcatcagtacttgcccaggaatttcagtctttgtggcttagactgtcgttcaagtttatttagtaccccagaacactttaacttatggcagtgaggcttgctggatttcagattctgactgctggaatgggcaatttcactctggctagggctggtctatattctccctccactggcgctagctgagttctgcccagtgttgctttccactgtgacagggcagcactgagttccaaagcaaagtcccccagtcgctgcactctccctcccccgagcacaaagattcactctctgtgccacgtggccactgctgacgcatgggggaggggtggcatcggccattcaagactttctttcctaccctcttcagtgcctttttcactgatatatagcttaaaccaggtacagagattgctcacctgatttttggttcttagatggtacctttttgtgtggatcattgttaaattttgtattcctacaaggaggatgattggtggaggcttctatttggtcatcttgctctgcctttccaaaataatttttattctgtaacatgttgccctgttacccacaaaattgataaaccagacttccttatcttcacccaggttgttggttaaaatgcaaaattagaattctggatgtcctttgaatcatgtttccaggttaatctcaagctattaatcaatactgtctgagtacagtatttaaccagcaaccagcaattaatctacccaagagactatcatcaacatcacatttcaaacaacaaaaatcaatgatatggttacaacaaaaatcagtgatatatttaatagtccatgttttttttctataaatcaatattgcgtatctggcactgtagtactcatatctatcccatttcttttgttgaaattctcaataacctcaacttttgatttcaaatgttaggccttattatatttaatgagaattaacactacttaataatgttcatattatatgaatggccattatgctgttttcgtgttttaaaaaaagtttgcaaaaaacattaattttttgcctaaattattttgaacattagacatgttatattttagcaaccctaataataataatttttaattattacacttaatatcctgcccactttgaaatattgacatcatagagcttatgtatgagacaggtaattaagtagttaacatttagtaaggatgttttatgtggcaggtactattcttagcattatacacccattaccgtacttaatgttcacaccaacactatgaggtagacactttttttaatatactttaagttctagggtacatgtgcacaacgtgcaggtttgttacataggtatacattgccatgttggtttactgcacccattaactcgtcatttacattaggtatatctcctaatgctttccctccccctcccccctccccccaccacatgacaggccccagtgtgtgatgttccccttcctgtgtccaagtgttctcattgttcagttcccacctatgagtgagaacatgcagtgtttggttttctgtccttgctatactttgctcagaatgatggtttccagtttcatccgtgtccctacaaagttattatcctttccagatgaagaaactgaagttcagagaagttaagtggcttaccaaaagtcacacgaccaggattcaagcctggataatgtggctccagggtctgttcccctaaccactatttcataataaggactatcttccaactaactctgtatgttacatactgctagttcaaagccaggtagacgaaaaaatactccctgtttcagctgaagaaggttttccaatatatttttagctgcaaatataaaataccacaaagccaatttacattaaaggagaattgtacattcaacacatcagcatttccacaggattgtagaataatatattagaacaaaaatagtgtttgtaatagaaatacagttattttactttggagaatgggcttggaaatggcagagataagaattataagttatttataattagcttaataatttcggtattcttatctgcagccatacagagttatgtgagttgtgaactgggataggacattaaagctgacagggttacatctggatcagaaacaagacaaaaaagatatgcctcttcatgagcctcatcaatgccccagcatatattgttattgctagcacaacattagggttttgtctaaattttacttatggttttagtgtattttaaaatatttaaacaataaattttattttacataatctcaattcaagatttcatacttatatcttttgttatcagagaatattaattaaaatttaccatgtacatagaagaaatagatatataatatgcctcatttaataatagggctatgttattataacaaagcatctgctctgtctttctctcaacagaccaaattaatctttgccacattattccttggacatttgagaggttaaaatatatgcgcatatacatgtaaaaccaatttgaaaaataaaagttcccaaatgtttattcagtgtctactttgtggcaggcactgacctgagggccgaagaaaaatagggagggtctttcccacaagaaggaagaaaaggaacagatggtgcatgattaccaggttcagtggtttgcatggagtgctcttcaagcactgataaaaagtgtctaaatcagattagatggaacaatgtcagatatggcttttagaggatgtgaatctgacctcaatttgagaatgggtagtagttacctacatagggatgaccatttatgcataaagtacagatacagttaatcccactttttgataatgagggcctggaattctttcatatctaatgaaagaataaacctcctagaaagtccatgcagattgtatggtacacattttaattggtgcctaagaatgactgtagttggagaaaggaaggtgaaaactgaataatattcttgagctgagaatatttctatagccttactttaagcacacatcttaaatccaggctaaaactcttagactggcattggcaattagctatttcatggatataaactaaggagacttgacgttaccaacctgcttggggagtattttgctgagtctatccaactgttatcaattcgagaacaatactttttaatttgaatcaacctgtttttttaaaaaaggttttgttttaactaaattcatctgttctccccacaaaaagccagtttgtttgtacttacatatctctatgtatacatgtatatatttttgagtctgcaatattcttgtcagaataattttgcttccttgaatatttcaactattcaaaaatttactgggttaaaacaacacacacttactatctcacagtttccaagggtcaggagtctaggcatggcctagctggtcctctgcaaggctgcaatctaaggtcactagggttcagttttcatctggaggcaccactggtgatggatcaactcctgaggtcactcatgataatgagagaattaatttccttgcagccgcaagactgacggtcgcaacttcttggtggctgttacttatatcagaggttacgtatcagaggttacattagctcttagaagccatcctcagttcgctactaccttgccctcgccatagaccctttacaacaagcagcctgcttcttcaaatccagcaagagaggaagagagtgagtttgctagtatgactggattttatatagcataagcataagagtgacagggcatcacttttgccacatcttatttgttagaagcaacttaaagttcctgcccatattcaagatgaggaaaatataaacagttgtgaataccaggaggaaagaatcatgagggttaccctgatatctgtctgccacatcccaaaaagaaaatctatttcaggctttggtatcatttgaaaggtttccagataatcaggtagtcaacattaaataattgtttgaatgacatttaactattgcacaaacaggtgcctctttaaaaaaaaaatacacacacatatacacatacacttttttaaagcagagtccaagtgtgccagtaactgacttgagtataaagcttatttttttaatgttatttatctttcaaaccataacagaaaataattttatttcaaatgatggttatatatttttatcattattaaatataatactatttttctccaaatttatcccacaaattttctcttttttgtgtaattgattgtgtatagtataaaactataggtcactagttttagcaactgattgaatttaaactgattatgtgtttggattttctatataagctaattttaattacattaaatgtttatagcagtttgtaaaaagagatgcaatcgtaacattttattctatattattttaataaacaatctatttttatataacaaaatctataaagatattgacaagaatattaggttatattaaatgtttacaaatggtcttttagattaaataagttgcattgaaataatgtgcttcagtctttcaaattcattttaacaatttgttcagcaaatattttattaagcaagtgtcaagtatgtactaaaagcttacaacacaagagcaaccaagtcacatattatttgaagccctaaatattcagggctatgttagaagagtattaatatgaaataatgaataaggacattaaaagtcagagagtttaattgatatattataggttataaatttagggatcctaaaattgggattggagtccaggtcttctgtatcacagtttactggcctttcactacctcttgtagctcttaagtaataagttgccttcatttgtcagagagggtgatcagtgccctgcaaagttcttttcatgaagcagttatagctttgtgttgatccatagactctctggtttgttccccattgagaccagctaagccatgagtcacaagctgatggttagagttcagcttggaaacatgaaacagaatgaggttaatgacacagatcagaatcaagcctgtgactttgttttcattagtatcatgctctacataaatttgctagccagtcgtagatgtcaaagtagaattcaatctatacattagtttttctcttcctcctttgacctccagccgtgtaatgaaagacttcttcaagaaggatggccgggcatggtggctcacacctgtaatcccagcactttgggagcccgaggcagatggatcacttgagaccaatagttcaagaccagcctggccaaaatgatgaaaccccctctctactaaaaaaaaaaaaaaaaaaaaaaaaaaaaattagccgggcatggtggtgcacccctgtggtcccagctacttgggaggctgaggcaggaaaattgcttgaacccaggaggtggaggttgcagtgaggtgagattgcaccattgcactccagcctggatggtagagtgagactctgtctcaaaaagaaaaaaaaaaggaatctatgtagttttatagatttgcaaaaaatactatattcccaatgtatgctgtgactcttaaaagtatttactaaatgttgccaatatctagaaccatctcttaaaaaatatttcaaacatatcagtgttaacaattaatggtgaaacaacaatgtgattaaatggtgttttaagtaggttttaaaaccaaattatatgtacattgcattggcttgtcagactctagttattaaatgcatcgattttaccctgggaacactcttatttccctacagtttaccttttaataagtgcagttggcacatgttttgaccagagttattatatgtcttattgttcactgtatgtctgggacttttttttgttttgcatgaacttggcagcaaattcaaaacttttctcacattaataaagctactggttaaaatatgtcaagggcagagtagctcattcttgtaatacggttgtatatacacacacctttgttttgttgttatagaaaatgctaattagtatttcctgatgacatgtgagcttgttgcatagattattttccacttaccttaggtcttggtgtattaggcaggctgcgaagcacagcttgcaggggagggccaccattgtccttttctccttcaaatattatataaaagttcaggaaaaaaagcattctcatagattatattttgtgactgactacccgtattttggggtttgtgtggtgtgatgagtagagattaaataatggaactaacttggttatagatagttctggggactaggagattaaagacaataacagatgtggggaaaaattacttttgtagaaatattcaagagaaattatttcagagaaataaatgtatgtttcatgtttagttcaatgttattttcaaaggattatgtacaagagaacccccactgtattttttccggagtgatgatgttcctgataatttatgtcaccaaaaagaaatgtgttctaaataaatgaaaattacctttagaaaaatacctgatttactcatacttcctattaagagtaagacacgaatatgagagggaaaagtaatacaatcctgacataatgcaatgccttagtccctagtgaggtaaaatatgtgatacatatatgtttaatggacattattgtgaagaatacaagaacaatgacagttatttatattgcaacttagaaaggatacaaatgaatggttttctttctcaaaacaaactgtaaaactaaggcaaaccattttcctttccaaggtctgctgaagctgacagctgccacaaagcttattcccagtgttctccaatatgtagccacaacaagttgttgagtcctcttaaataactaatgtcagttattaatataaactttagagtactcttaattgtgattgcaccatctctttccttggtttctgggaccatttctattcttcttcctatggactcacctttcttcagtgtccttttctgattccttctaatttgtccaattcaatcctcagactgttccattctgccctagctggtcatccattgactgacaattcacaaatctatttctccagcttcagccacaaaagagagttaatatgtccactctaactcagaatctctatagagaaatgtacaaattatactcaaggtagacaaacacaagtacactatgtttttgtactccacttgaagctttaatagattctctccaacttaatctgtcttaaaacaaactctggatttacaaccttcaaacctgctccttccccagaaaccccacttcactcaatagaagcactataatttgggttgctaagaccaaacatcttcaatttcttttcctttctttccttttacacacatacacacacacacacacacacacacacacacacacacacacacacacccctatcagtaaattataaccaagccttaactatacttccccttctcctacctacttcttccacgccgggccaagccagttatctttcttaattgttgaaatagcttccaatctgctatatgtatctccacacttgccattctaccgtctgttttcaacatggcagccagagtatgatcttcttaaaataaaactcagaccatgtcacacttctcaaaacctgtcaaaggcttccatctcattctgaatcaaagttaaaacctcttcccccaaacacacacacacacacacacacgcacatgcacacacacacacacacacacacacacatacatcttcctggctttgtcttttctgatctctccctcaacttgctccagccacacaggcctcctagttgtcttgccctgccccacagactttgtcctgacaatcctgtctgcctgtaatgcatttacctagcttccctcaggtctctgctcaaaaatcacctcaacagagaggactttcctgaccacatcttgtaaaattgcatacctccctctcccaggctccttacctttcccaggctccttaaccaccccccatctttgtttttctccacagaacttattatcacctgataaaatatgtatattaatttgttgtctattgtctactttaaggatgacagggattttgtaatatttgtgccatagtctagcacctaggacatgtagtagttattcatatgtattaaataaataagttatatgaaatatatcatttaacagctgtttgcacaagtgggagtcaatatgtcaatttcaacttagaatttctgtagagaaatgtacatattctactcaaggtggcccagactattcttaaaccatatttaagaaggtgaaatagagatatgatttgatggtttttattattatatggttttcagtattggatacagcagtgcacaaattatattaaaactacaattaaaaactacaatttcatgccaaaaaaaccctgattttactctgatcatccttcaaggctgttgttcttgattctagcattgatatttcatgtttatttcattacattttatactattttaaaatattaaatatttaaagcatatataagctattttcacagttgatttgcattaagtggaagttaatatgtcaattctaactcagaatttctaagtagaaatatacatattatgcctgaggtagacaaatacaaatatactatatttactataccatgactatttagtatctttaatcccataaaaattaattacctgacttatttccaccaaagctcttctaattaaagttttggaccacagtgaaagaaaataagctttaatttatatgtattaaattttgtatatcttcctttttctctctccaatggaagtcttatgaatgtgtaatttagacatgtttgtctagctctcacatatatgaaaggtgttactgttagcttttctaaacagaacattgtaacaactgccacacctacaaccccattcagccagaagtgcaactccccaagctttgggaattttctactaaaggacttgaaagagtcaatgtttcatagttaagttgggattaaggaaccatcttgaccacagatttctgaatttttttagtatataataatcattggcaattatcttgtccaataccttccatataaaaataagaaaaaatgaaatattcctcatgcccttggaaaattgctggcttagttttcttttccctgtaatggcttaccatctggtcattcaaactgggccagccacttctcaaggctgccacactagcctattgctccttccatgatgttttccccaatgtttgtatttctggttcctccatgtcattcagttctcagcttgaagaacacttgtcagggaggtcttctctggcacccaatctaaagcagccttcagtcacctactagcatatctcttattttatttttcagaataacatgcctcactatttcctttctgaagtgtttgtttttagatttattatgtgttattgttcatcatggtacattaaatacagagggtagcagccttgattgttttgttcaccacagtatccccaatgagtggaacatttcctggcaattagttggtgctcaataattatgtatttaataaatgcatgatgtaatccttgttacttttcatatttgtattagtgactaaaaaccatgagggggcctaagaatgtacaacccaacaaatacagactttccaccagccacatcatgggccatttaaaaaaacacaaaattaactgatctaattgtcgtaagtcttcagagttatatgcccagttgtttttgacattgccagactactctttgataaacctgtcaatacaattaatttgttgataatatgcatatctcatcaccaagtgcagtcttactttcctgcatctgaaagaagaaagacaagaatgctttctgcttcctcttgacattttccttcccgggaaatattttcctcaagtatttaaggtgagttacattaaaatatagaaaaattagcttaaatcttttcttatcagaaaaataagctgatcatattcattcaacaaatgatttctgagcacctactatatatcaggctcttctgtcattgggattggtttctaatggaaggagcagataacaaacaaataactagacggcaacattcacgtgttattatatccttaccacagtcctttgatgtaggaattatcattcagactcacactgccagctgcagagttgggatttgaacataaatttctattagtttaaagcctcctccctttgtactttattgtttggaaaaagaatattctatgaaaatttaaataataataacaaaactgtgagtcttatagggctttaaaatcattataatttatacaaaaaataaattatccatttaaacagagaaattattcctatgttttggtcatagaaactaagtgcattatacattaccataatacattactttaaacatctaaaaaatgaattatagtataaattagacctcatcaaaagatcattcagttacatagtttatcagttattgtccaaagtgttctcagtaagacagctctaattgctttaaagtgtttaatatggcagacattagattctggtaggtggataagccaatctttaagtcaaccgatgctcctgtaactgcccagtgggttcattttgcctcctgcccagacagagccaatttatcaaaacaaacgaattgcaatagaaaaagtttaattcacgcagagcctgctgaacaggagaccagagtcttattattactcaaatcagtctctctgaaaattcagagactggggttttttaaggataatttggtagataggatgccagggagtgctgattggttcggtgggagatgaaatcatagggagttgaagctgtccacttgagctgagttggttcctgggtgagggacacaagaccagatgagccagtttatcaatctgggtggtgccagctgatccttcgagttcagggtccaaaaaatatctcaagcaccaatcttaggttttacaatagtgatgttatccctaggagcaactggggatttttagaatcttgtgacctctagatgcatgattcctaaatcgcaatttctaatcttgtggcaaatttgttagtcctacaacagccagtctggtccccaggcaagaaaagagtttgttttgggaaagggctattatcatctttgtttcaaagttaaactataaactaaattcttcccaaagttagtttggcctatgcccaggaatgaataaggacagcttggaggttaaaagcaagatggaatctgttaggtcatatctctttctctgtcataattttttcactgttataacttttacaaagacagttttactcctatgataatccttcagttagttcactgtctagttcctgggagtctgttttgtggatcctaaccctaccccaaggattctactgcattgtaaattctgactttacatttaagacatggagttctttgggggcagggagataaatatcctattttaactatcaagggttaaagtgctttcaaggatctagtgtctggtggtgataccagagtcatacaattcaaattacaagcatctgtttgttgtgttgagagcagggactgataaatgaggcactttttgattgtgcaactgggtataaaacagtcaaaatgatgcttataacttcaagcttttctcccacttgaatcagccaacaagattttcatacaacatttagaccagagtagctgatgcttctgtttcttgcattttgtctggtttgggatcaattttgtagtcatggatgtagttatagctctttggtatgtgaacatgagagaggtgtaagctcataaaataagaaaatctgtttttgttaaagtagacgatgtgcaattcagaaacaatgaaccatatcaactaaataatgggttaaatcagtagagactttgtcaatcttgtattgatttaatcatttcaaaattatttattcattgtctataggtatgctaggagaatagttgaatacaaaaaatgttcttacactcaggaacttcacaatcaggtgcaaaaatgagacaggcatactcacattaaaaattaaatgacaattcaagaggcggcacaggcagtctaggataaactgccatatgaataatagcaacaataaagtagatgagctcccaaaaaggaaagatcgaggaaggcagcatggaaaaatttgacattgccttgtgtttggagttgaacgagttggaagtgaataagtagaggtttttccacgttgcagagaagtacgatggtggggggtatatatggggcattcaaaatgcatgaaactaggaattcgtttgtcatctttaggaaatttcagaagtagtttctgaccattttatgtgggtcctttattttcaagtttagacattgggattttatcctgagaataatggggaaccattgaaggttttctacaggggacaaggatagcatgttggaatgactaaccagatagaaatatgcacaatttcttgaaaatagggagaacgagaaaggaagaaagcagaacagtggttcttgactttaatgtgccacctaagggccaggtgcagtgggtcacacccgtaatcccagcactttgggaggccgaggtgggtggattgcttgagtccaggtgtttgagacaaggctgagcaacatggtaaaactccatgtctacaaaaaaatacaaaagtggtggtgtgtgcctgtaatcccgctgctcgggatgctgaagtgggaggatcgattgaggccacaacattgaagctgcagtgagccatgattgcgccagggcactccagcctgggtaacagagcaagacccctttgtctcaaaagaaaaaaaaaatccacctaaggagcttgttaaaattgccgattcctgaaccttactccagagattctggttcagcaagtctggagaggacgcataatctccctgttaagggttagattctaaataagtggtcttcaggccacattttgaataatactaaattagaaggctgtcacaataatctaggagtgaaatggtgaaggtttgtattataattttggaagcagggatgaaaagaaagtgatggttggtagagatatagtgaaggaagaattgataagacctagaaatgtttgggtataagaaatcaaagggaagaaatagttttaaatgatattaatgtatttatcatatttgatatttttgttaatgtaactggatttgcaagtcacttaacttactttaaaaagccagtgcaaataaaaataatgtacaaatgtaaaccaagttgaaaatataagatcaaatgatgggtatgggaatatctgtaaataggaaagaaattcataaaaaattaagctaccactttgtgttatttccaagtgtattctaataattagttttccccatcatggatttaattaattcttagtcaagatttctggatttctttaatcattaccttttgaaagtagatgtagaattctcaattatctaaatcttccacatttagctgagagaccaactctagggaatatattagagtattttcatagttccatcagactatgaaccccaattcttagttaaggcactatagctatgggaattatagtccatagtgaataaaatatacaatcatggaccttattttgaatagcttccagaacaaacatatgcgaacatcttgaggaggttattatggctaggttctagcttgcatcactaagtcatcaagaatgggagacaaaaggtataaggaaaagttttcagtagaaattataataattgtcagaggaattatttcagtctcaggttgatgcaaatttgggtacagtggatgctgcttccacttgttttcggaagccgtaaccaataatcaaaagcaagcaacttttccaaaagtaattccatcttgttttttaaaaaaaagtttgagtttatttaatatcttcatttagacatgtgaacaaattgtttgcctttttcattaatgacatctgagtacttgtgtagattgccttcatagttcatttgaggcataatgcctcaaattaggaactggaaatgtttctttttaaacatgaatattgcctaaaattgctgaaattaccaagtctttaatttcatcaacagaagaaaataggcaaagaaattcaggcaaattgaagagttaaaacgttatgtataggtcaggttcagttcagtgcaaataactgtaatattcctttatgttttaaagggatgtttggtttgagagggaatgctttcaccttctgaaagggaagagggaggtcaaatagtgacaaaagaatgaggacttgggggaagtttcagctaagaggacaagcaaaagaaggctgagaacaaacagcaatttgtggtgggcatgtttgggagctgtaaagagaatagctcttgctttggagtaaacttcctcagtcagaactaggtccttgaattcagaccagctctcatctccttggtccactctagggctgatggaggctgctgaaatcatcttttgctacattaatactcatttttcgctcaaagatgacaaggagtatttaaacgcagagagaatgttatttataaatgatgatttgttcgtgatagaacttgccacatagtattttctcttttttaacttttattttaggttcaggggtacatgtgcaggtttgttatataggtaagctagtgtgatggaggtttgttgtaacaggttattttatttcatcacccaggtactacgcctagtacccgataattattttttcttttcctccccctcctcccatcttccaccatcaagtagatagaccctagtgtctattgtttctttctttgtgtccacgagttctcttaatttagctcccacttataaatgagaacatttactaaatggatctttataaaaacagtttgccgaccactaatgaataagaaaatattagaataaaaaagctcaatgtcactgatcattagagaaatgcaaatcaaaaccacaatgagataccatcttactccagtcagaatggctgtgattaaaaagtcaaaaaaataacagctgctggcaagatttaggagaaaagggaccagtattcggttttctgttcctgcgttagtttgctaaggataatgtcctccaactccatccgtgttcccgccagtgacattatctcattctttttatggctgtgtagtattctgtggagtatatgtaccacattttctttaccaaatctgtcattgacaggcatttaggttaattccatctctttgctattgtgaacagtgctgcaaggaacattcacgtgcatgtgtttttatggtagaacaatttatattcctttgggtatatacccagttgtgggtttgctaggttgaatggtagttctgtttttagctctttgagaaaccatcacactgcttcctacaatggttgaactaatttacactcccatcaacagtgtataaatggtcccttttctcctccattctgactggaataagatggtatctcattgtgattttgatttgcatttctctaatgatcagtgatattgagcttttttattctaatattttcttattcattagtggtcagcaaactgtttttataaagattcgtttagtaaatattttagactttgtgagatatacagtctctgtcatactcaactctgccactgaagtatgagagcaatcattgacatttactcatgtaattacatgggtttggctatgttccaataaaactttatttacaaaaacagatagcgagctgaatttgtctaatagccacagtttgcctgaccctgtttcattgcagtatgtgctatttctattgtgaatgaaaaggctagcttagaaggctaactactttttctggcttaggaagctaactactttctctagcatagtttcctagagaaataggttctcgattaaaaatagataggaacctgacccacactgtatctggcaaattctttaactaaagaaatgtaaaacgctttggaggtacctaaatagtggctaaaaattgagttccagtgttttctaattatgagatgaggacacattttcctcatctgtaaattaggaataacaataccttcttcataaaaaggccatggctatcaaatgccatcgcataagtgaagtgcccactgcagcagcatctgacatagtaggccctccagtaaacatctgttttctcccttctccattgccaggaaacacatatggaatagaaataaaagtagaaacaaaggagagaagaaggcagaactagtttcagttttaaaatacagaagctctttatctcactaaaatattcattgccggcttaaaggcaaagccctattactagttcaacacagttcataattttcaaaagcactacccctgtcatggtactgtgggagttcttggttttttactcccctaatttcctaaattatatgtataacatcatatatggaatataataatgtatatatgcgtgtatacttaggtatacatgcattatttatgtaacagatattgtgctgagcattttacatctattatctcatataatctttacagtaacattgcaaagttgattctgttattttcatcgatgaaaaaactgacagagaggttaatgtaacccatctgtggttacacatctagaaagtcttggagctgaaacggaaactcagggcgttctggctgtaatgcccattctcttaataaccatgataaatgacatacttttaagaatgaataatatttaactgtgatgagactactgatttggtttagattcatcatttctaagttacttgaccaacatcaaagaagaactgggtcaattagtccaatctgtggtttataattggccaattagtccacatctttgaatctgcacagggaccacttgcacataaatctagatctacatttgccacgctccacaaagcattctgaacaattcactgtgttcaaaaatgagatttctattatttatgcatgaagaaaatatgctgttttccatgcactgagccagggggaaaactactcagccttggtaatattagaccatggatcttccatttattttaaatgatagtgtcatgctgaggaaaataatggttcatatccttcttctccttcctccaaatactatgtcaaaactactttgattaaaataaataaaatcttgtatcactgtgccaactctgtaagaagacagagcaagcaagcaaacacattaaaaactaaggtgttggagagtctgccgtgacttgtgaattctgtatattttttcctttcctgaagttcttattttcttttcttttacttaccaagttacttggaaatttaacaatttaataaaaataaacagcatcttttcccaatatttaaaaaaatgtattattcattaaaaattttgcattcacaaaaaagtgaataattgggctccaatctgagttagtttatgagtgttccccaggtacctatcctctctcttttggagagaacatgtattccttgaggacagattaagaaactagtcttcccttaatgctgggagcctctttgaagtcttatttacttcagatcttaagggagaattgtggtacgctgaaaagtatcacatttgttatcacttgaggaaacaccatttgatctaatgagctagactttttcatctttcaattcatgacagctatagctacattagaaattgcattttggaggtcttggataattatctaaaaatattcacaaaccccttggaggctaatgaatttaaacttggatggctaatcctaaaatggctttattccagcaaagtgggagagaaactccccttcttctgtttatttaaggtttctagtttggggtcctggttctagtttggagtcctggagttcctttcaatgtgtttccataatagcctgattcagaggagtcggggagaaagaaagaaacaaaaagaaaatgccttgtttattttatttacatatatacatacatatctatacatatgtaaaatgcacatggtaaagcatagtattttgcacaaaatcttaagtaaagacagacttgggtttagatttataataggatttagtaatactaataccaataacagcagcagcaaattcttgagtgcatgaaatggattactttatgtaatttctgcaaagtcctatcatgtatattttgtcactagtttattttacagatgaggaaactaaggctcagcaaagctgtaaaacttggccaaaaagtcatgcaatttttgaggattctgatttgctctgtctggtgcttatacccatcttcttaaatagaacaatcatgaggaaattgacaatgtccacagacataagacacgcttgcagagaactaggtattgggacactgcagagaggcaggcagggaacactggcctgaagtatgagctttgaaactggcagtcttcattgtaatcctggctttgcccttgctgtctgtgtgtccttggatgagttaccatcttctgtgtgcttcagtttctttatctgtacaatcgggatagtaataaactaatttttgaaaaccagctaaaataatgcctggttcatagtaaacccaataagtagtagttgtcaatttattaggttggtgcaaaagtaattgcagttttttttctattactttcaatcacaaaaatcgcaattacctttacaacaagctaataggtatcctgcctgctctgtcttatccctttcaccctttagagcagctaaacattagacgagtgcctcatccagagatttattgcaatattttatacatcagaacagtttgaagaacctgagataatattgagaagatagagaatttttctctgtcactccccatcttctattttaaactagtaattctcctctcttgcctgcaaaccccgcttcctaatccttaggcaactgtcctgagttcttgttagttattactaattcctgctgtgatgttcgttgatagctacaatgttagatgataaggaatattatattttaaagtcagatatttgagaaataaaattgcattctcactccaagaaaagtttctgcatatccaaaggatgtgggggatagatatttaggaatatatgtgtgccaggattgggcaactcgcagccaaagaatggaacaggtttaccttggatttgagagctacacacaccacttcacaaaaatttttatcttaatttggtattaactttatttaactataaaactttaaaactaaactttgagaggaggatgaattttgttttaaagatgtttgtagttatttttagctcagagttctatttaggttccccaaattttgtgctacaacagttttaaaagtctgcccagttatttaatctggggagattacaaatacagtgttgacgactggcctgcagctctctcttctgaaatgagatattcaactccacatggcttactgcctcttcctatcccacttagtttccatctcttctgctggtgatgatgtgagttccctaccctgtggggttacaattgcccttatggtttttcttatacaatattcagcattataacatatgtaggttatagagcatataatatatgaactgcaatattatcaatatgttgtatctacctgtgggctccttccttctctcagttaccatattttccttcaccactcactgggtaacaaccatctgaaatttcatgaattgcataacctttccatttttaatacttttaaaaaatcatatatgtatgtatcctctaaaatcttgctatgtaagtatggtccacagatctatgcatgaacattgcctgggagcttattagaaatactgaatttcagcattgccccagacctactgaaccaaaataagtattttaacaagaattgctgttgatttacaggcacattagtttaagaagcactacaccaaaatatattattttgtcttcctaggggttgttttgtttgcttgttttcttatttgtttcttgtttttgagtgttataagaatgacattctgtttgttgtcttctgctacttgctttgtttgctcaacagggcattttaagattcatccaggttgctttctgtagttgttcatggcttcctgatgtaacatttgtgctaatagtccttcctgctaaacacttagtttgtttctagcttgtgttatagtgtataatcctgctatgaacagtctggtgcatgtctccgtgtgtgtgtgtgtgtgtgtgtgtgtgtgtgtgtgtgtgtgtgtgtgtgtgtgtttgcatgtaagacattttctgtgctgtgtacccaggagtagaattatgaattgtagtgtatgtgaatgtttacctttaccagataatggtaaattgttttaccaccagcagtatatgagttttcattgatctacatcttttcaaatacatggtgtcatcaggctttttactttttgctgacctagtggacataaaatgtcctctcactgtggtctttatttgcatctccctgataactaatgagattggtcaattttttcatctatttaattaccattctgttttccttttctgtgacgtgccttttcatgtattttgactatttttccatttttctctcattgattcataggagtacttattttgaaatagtcctttgagagttacatgggttgctatgttttcttccaatttatgacttatcctctcactttcttgatcactcttgaatagaagttccaaatgttagtatagtttatcagtctttcgctgtaactgcttttgtatcttttaaaaaaatccttccttgcatgaatactataatactattctaataatttcagtggatgggtggtttaatacataattagagctctaggatgatattaactgaaatattaaaccagtcttcaactggtattcttaaataactcatcaattggcattttactttcaaaaggcctatgtttaatttctcccatttgtcatccaggcaagatcacaagttttggacttagcttgacgaggctcaaatccaggctttgaaacagcaagtatctgaccttagttaagtaattgtccccataagcttcagtttcctcatatgtaaaatagttgctgctacaattcttctattttaagaaatccgttaattacaatagttgagtcaatttaatgggagctttttaaaatgagaactattagtttaaatttacattttcttaagtgatttaaaaatgcatacattttgccttaccaatgcctacctaccacattacttttcatcatctcaaactataagattaaatcttttctacattaagaatctaaagatctttatacagttttagcctttggtagttgggcctaatttcaaagtgacaagctctttcatgatctcttttacatttttgagatcaagagtgacatttcaaggcatattgattcatttttataaaaaatataattatcaaccacaaaaagttaaacatctctaaaaagttagctaagagcttgtgacagatggacatttagcaactgagtaatcattcttcaggtctcacaaatctgtcactttgaaagttctatgacatcttctgagggatttggtaatatctactcattttaactgtattgctgctgtgtgactggccatgattttatagacatttcaatgctaaagcaatatgcagcttccaatatcattcttatgaatatcttgttgcttttcaataagatatggaagtgcagtttttctcccaggaagaaatattttttcacttatagtaaatctttgtctcctacccatgttttaattttcttcctatatacaaaataacttagctcttcaatgaggtattaataattatagtatgaacttttgaagacattttaagtaaatagtgtatatatatatgtgtgtgtgtgtgtgtgtgtgtgtatatatatatatatatttttttttgatatggagtcttgctctattgcctgggttagagtgcagtggtgtgatcatggctcactgcaacattcacctcccgggttcaagcaattttcctgcctcaggctccagagaggctggggttacagttgtgcattaccacacctggctagtttttgtatttttagtagagacagggtttcaccatgttggccaggctggtcttgaactcctgacatcaagtgatccgcccaccttggcctacaaagtgctgggattacaggcatgagccactgcacccagccaaatagtcttaatttagttaagtgcaaagttcatcaatctgtagctatatgaatgcaagtcagaaatccaaagtccttaccatgaccagcatggacttccttgatctgtcatttccaaacagctttcacctgacttcatcccaggccactggttgatttactattcctcagccataacaagctggctgccatgtctttgcacttgattttcccacagcctggagtgctggcttactcccttgcttccttcaggccactctaccattactcttttggataagcctaacttgccagccaatgcaaaatagcactcccaaacatcacactccaacttcttaatttgcttcagtttgcttcataacactgagctcctgtatctgatattattatttatatttctctaattaaaagaaatggaataaacacttaagcatctatatatatatatttaccacttaagcatatatatatatatttaccacttaagcatgcatatgtatatataaatacatatatatatatgtgcttaggtgtttattctgtcttttttaattagaagaggagggccagaacttttctttattgacttttttatctccagaacttagggttggcacatattaagtgctcaataaatattggttaaatggctgaattaatgttgagacaatcaggtgaacaggtgttttctatgtagagttaagagtccaacgggctattctcaacattggcagaggactagcacagttctttagtccccactgaaagactcatcctgatcattataatgttaaaatgtgatgaaaaaagcatactgttgcaagaattaaataaaataatgtatggaaaatgtttgccagaatcagaatatcaaatgttaattgttcaataaatgcaataaaattaattccatctgaatcaatccttaccccttcctttcctgtaacagtggaaatgttggcttttttctagtttgggcaaatgcttccatctgtgccctgcagttcaacgcccctcaaccccatcttctcagggacaacatattgttattttccttccttctgtcatatctgttatttctccctctctttgcatcctactcatcaactttaaaacctgctccactcagaagggggtccttttgataatgtatacaaagtcactacattgcctttaggggacactgaataagaagtaattctttatcaggcttctgcttattgctcagctgtccttgcaggtttatagacttatttgccattttctgaatgtccaatgccccacaatatctctcatctctaagttattgtctgcgccagtctctgcccaaaatgcctttactccttcatctccccaagacgtacacacattcatggtcacacatatgtattcacacatactgaaaatagctaatttcaatgtgtacttgaggtcttggcctcagattagatgccactctccctttggtgaggactcactgagctgtaagggttgaatgttcttccagcagacactacatatccgcatcagtatatctcttccccccatcttcccaaattatagttgcttatttatttatttcctctgcaagacacaaaactccttgaggatagtaattttttgtgcatgtttgtcaatgcagtatcacagtcgtcctgagaattagcacacagtagataagcaatatttttaccttgagctgacaagtggaatggtatcattagaaagttacaaaattgattttgtgatactgagcctccaactagttggaaattagtgtgctgctaaatttgcattagtgtgctagtcaaagacaaggatattcaagtacagcatttcttagtttcatattaattgcatatttctgtttatttcatattagacaaaaattactgaaaagcagcctaatatactgcgttggaaacaatatgatagagactttaatactagtacttgtactggcaatactgacaatattatcttgtatatgtataggtttttacaaatttaaaagcctttcatatatctcaaggaaatatcctaagaacctgtttctactcaacattaaagacctaagtgaaatctgagactttcaatgcctttggatatgtaattagacaggagtttagccttttgtaacacatatgatgatgaaaatttccgattttaagctgactgttgggcatcaagatgaccatctttacaaatgaagtagcactcatgtgctcaagtatacatagaatgtatgcaaagtgaaagtctcctttaaatcttcctcccattgacttgagcaacgagaacacgtggacacagggaggggaacattacacactggggcctgtcggggggtgggatgctggaggagggatagcattaggagaaatacctaatgtaaatgacaagttaatgggtgcagcaaaccaacatggtacatgtatacctatgtaacaaacctgcacattgagcacatggaccccataacttaaagtataataaaaaaagtaaaaaaaaaaatcctcctcccattgccaagatagaaatggacccttagttactgccacttgccatctcactctgtgttctggatagaaatggtgcttgctctctgctagctgttaattgacatcacttctgccagaactctccatcattattgacaagaatgttctcccttgttaattgcccagcagcacattgagtgattgattgtatcttttggacagatttgaaatgcatttgcagaaaagggtgggggtggtaatgacataatgcatggtaatgacaccaactaactgcttatttaagtttgttcaggaaaaagatactgatcatttacctgatttttactttttatatagatgtgctaatggtaagtagtgatagctttccaggatgtcccacattaacccaatgcttcacaaaaatctctctcagactgtgcccataaaactccaaaatctatggtcaactagtgggaaaaagaatggataatttatttaacatataagcagggaaaaccaatgggtagatggaatattttacatttttgttgttttaattaaaagtaggaaatacctagattaatgagaagagtttttaaatggaaggctgggagtgctcaatattcagcagtataagattttcttttagcatagaggcaactagagtaatacataaagtgcatattttcatgagaactttgcttataagctggacttccctagaagtatttgagacacaagggcgagtcaactaatagtatctacagtgtttttgcaaccatttaatgagagagtaagtctggatcagtagttgctgatgtatgaaatcacatgaagagttttttaaaatgccgatgccttgatcctcccctagaaatactgattttatttgtctaggcagggtagtgatgatcaaactttacactgaagcagcatcttctcacaaatttggtaaaagtataaagcctcaagccctatcctgcttcatggagcctgggtctttgtgtgctggattagctctcctggtgattctgataacatcaaagtttggaatcactgctctaggttcaacatcagacattttttttcaagctcccccaggtgatattccctaggtacagccaagactgggaactgctgattaacatgatatttaggatacttcccagcctggcaggaataataaaaattgctacctttattaaacattcattgcatataaggcattgtgctaagtattatttcattaaataattgcaaaattctgtgaagtaggtaatattagtactactttgcatatgggagacagggatggtaaataatttagctaaagtaacatgggtaggaagtggtagattggaactcaagctgtaacctcaaagatcacacaagaaactattactatcaataacattttggaattataagttaaattaaaaactctacaagttggaaacatattaaatgattttcttacattttaaaatgttcctgacttgcaattacatagtaaaaacaaaacaaagaatttttaaaaatcagtgggaaatatataaaagataaagttttcatgagtaaaaaggaaggagcaaattggtggtgaaaatcaggttggatttgaattattccaatttaatctggaaaaaaattataagtcacttgtactgttagtgtatgagaaattagaataagagtttcggatagaggtattttgccacagttatattgaggcgaaaggtggcaagcatttcaggggaaagaagaaatttgtgtacttctttaaaatggttttggatgttaataatgcaatgaattaaaagaaaaaggcagtctatactgcagaacacttccatttctctccttttgtgtttgggaaaatactggcttagtgccctcctaggcatggtaaatactttgaccactgccaccagtcacacttgtgtctgcaaaaggggcaaaaagagtgcctttgtaaagtatggtttaatcctacacagtggagagtggtgcttaggagattgccttgtttctcttaagacacaacctttctcagattttgtgtatagtccacatatgagcagagggctcatattaaactgatggaggaaaggtatatttccaaccataaataaataaatagcatgaagagatgatgaaggccttctcctgccacttgcacatttcgtggactgttcttgctgataaacaaagtgagcacttattttcattggcattattttcccagtggcatctagactgtgtggagagtgttgaattttcagcagtctagagagtttgagacatggttcctgattctggtactctagcatccattacatgatatgcttgaaatgtacatatgaaaatatgttaagactgagtgtgtgggaagaatagaataattacacagccaacaagttgttgtgagtcctaaatatattatcgttcaaataatggatggtacgtggtaacttccacaaagaaaaattctagaattattttaacagtaagcaaattgcatttcatctttaagtaatatggtcaaataaaaaaggtacagggaaaaaagtgtctatatattgccctgaaatcctcttggcttctttaaaaaacatttgacactgcaggaaaatgctaattaaaggaagacaaaagttgaatttggattctagtgcctcataggactctaatttctgtgaatattgatacaacatgtttttaaaacactttagtaatagagctgtgttctgctggaagtggcagaaaggcaaattgcaggcaggcactgaagatagagactaccgaagataatcagaggtttgtaattgaaaaggtgccttaaccttaactctggccagcgggctcagccatggctctgcaactaaggacgactcgccttgatttccagcgaggaccactcccgaggccaagttggaggaagatcttcaagaggaaacattgggcattctccctgctgtgggaaagagccacacaatgttttatcctatgtcagggaaagagactgaattaatcttactattggatcttcacccagatccaatttttcagcgacgcgcatagacaatattccaggcaactttgcctggtcacattccttatctttggaagcaccagcatggggctcatcgtcaacaagctctgagaaccagccaggaatcgccaaactccatttctctaagagcactgaggcaagcggaggtgaagaggaaggctccggggcagtggggagcagtgtggaggagggaggcgcgggcacggcgaggggaaggatcaagaggacaggtctgactcctgactggctggagtggttttggtgaaagtcacagctcgggcgtgccagcctggagctgtccaacttttcagcagctccgggatcagggttccggtgccctggaggcggctaccactgccgccgccgccgttgctgctgcttctgcagcccgagttgctgacaatccctgctctcgccgccggcgcccaaaggaagggaagaagaaagggaggaagaaggaccaacctctggcgaaaccgggcaccgcgcaccctagtcttggtgacttggggagcccgggagcgtgtctctgccatagcctcggtggaaggagccctgccgcgttctgtgacccctcccgctggcagggccccctctcggtagccctgaggctctggcgccttcaagtgagaagctaagcaccagcctctgctgggctgcagaagcggcggcggcggcagcagcagcagcagcatcaggaaggcgctcgggccagcgcggtgaacccgggctgggcagcaggtcgcggagccgcgagccaggatggaggcagagggcagcagcgcgccggcccgggcgggcagcggagagggcagcgacagcgccggcggggccacgctcaaagcccccaagcatctctggaggcacgagcagcaccaccagtacccgctccggcagccccagttccgcctcctgcatccccatcaccacctgcccccgccgccgccaccctcgccccagccccagccccagtgtccgctacagccgccgccgccgccccccctgccgccgcccccgccgccgcccggggctgcccgcggccgctacgcctcgagcggggccaccggccgcgtccggcatcgcggctactcggacaccgagcgctacctgtactgtcgcgccatggaccgcacctcctacgcggtggagaccggccaccggcccggcctgaagaaatccaggatgtcctggccctcctcgttccagggactcaggcggtgagtggagagcgccccctcccccattcaggcaaagggtcacctccccttttctcaaatactccatctaagtcggcttatcaccaccaattctagacccagggtaaaatgctagtctggaaattgggggaggacaaacaggggtgtgcctatcctttattgagagtatgctattcaggtgtgtgtaagagaccccccaaaagtactgcataaatgttaactggggccgtgtgtgtgtgtgtgtgtgtgtgtgtgtgtgtgtgtgtgtgtggtgcgcgcgcttcccagttatctgtgccacgcaccagccctctccccacccacttccataccaccctggctagtgagactaaacaggcaaaatcagtttgctctgggtggagaagaagagaaggtgaaggttttgcgggatttgaccagcgaaagcacccagcatctgtccactcaccctattgggaagagggtcggtggggctgctctgactggggaggaggggggagtgagaaagcctggtcccaggattgcagctaaaagcctaagaacaactcgcatttctcttcgtcaggtggagaagtaaattgaatagcaaaaggggagaacacgtgggtgacttggagagtttggagcaaaatgttcagcaatccttgagagagacaagggggtgagggagggagaaggagcgaggacgctgtgggagttacactgtgtcggtgtgtgcgagcttgtgtgtagggagaccgtgtgtgtatcagtcgtccctgcaaaatcccaggaagaaagcgccttgttttagcagcaggcaagacgtagagatttgattatagtgatttccccttaacgtaagtgctccggaagacagggcagggaagccgcctatcaaccgggagttttagtagaagttgaccgctgcttctccaaggaaatgagtaaaggaccaattacagccattctgaggagtcagctccagattcttaactcaggcgtggaggtggatgtggggcccacgtttggtccctttcctgataacccagggacagctcctttcttccctgtcccaggccttccacgccgtgaatcccctcccccacacaggcacaggaaaaagatttcaggagctgctgatccttggcacatctaatagtaaagtagaggggtcgtcatctaaccttagatgtggacaggcatcgatgtactgcacctccaagccacaagtctgaacaatgggcagttataaattgtaaatcaggtctgggtgtggaaacaggaaaatctagggctgggattgtttgtccaactctgattgacagtaggttggactgatcagaaaatcataatggtgttcaaatgtgtgtttgagttttgtgtgtgtgtgtgtgtgtgagcatgtctctctgttgtatacactatgtacaagggaatccagccaaactatcataaccctgatgtgtacacatcatttcagcttgcatatatgctcttagccctttgcctggctcacacccttaggtaccttgttggagatgttcttgtacctgttggatgggaagaataagaattgtaattaataacctcaattcagatcaaagactgcagacttccataaattaatataaaagtttcatttttcagccaagactgctaagaccctttgtttgaagaggtggatgtccttctctctcccctttggttgagcacgacactatgtaggaccccaatgatagaatgaaggcaagcctgatactttgtatatttgacctattaatagaaaaataccgtgtgatgatgagcccttaataaacattaaataagaacaagagttctagcttgatctgtgggctgattgattttgtagagtttcttaattgacttcattttttaataaaatagaatatgcctgagagagtggaagaaagaaaaataagctaattggaatagaggtattgcatcattgatttgaatttattttttgctatgctttctacattgattaattgttctatttgaaatttttagttgaatggttcacaggcaaactaagatgtataatatttatatgtagctgccactgtggctcacctgatatatcattgtcattctatttaaggatccttagacttaaaattctttacaatacttgcatattccccacatgctcacacattgcatgtcatgtttttccttaatagagttgcttttgcaaataaatacatctttaaggaggacatggatattagtttcattctttaaagagaacagcaacaatacttttttattttaaagagaacagcaacaatgcttttaaattatcaaagaaattttacatttattaacttatttgaatcctacaacaacactgagatgagatggtattatctctatttgatagacaagaatgctgagccccagaagatgcgagcaatttgttcagtatcacatagactgtgagtgctagagctaagactgaaacccaagtctcctgcctcatcaaaggtggtgagcccaccttaaataaatgtgtgcagaacctgggcctgttgacagcatcaagaaatacatgaaaccaacgtgaagtttatatcgactgatactacaggacataaagcctgaatgaactaaaaatgagatatggtttaaatccatttttaacaaaatgacatatatcacaagcttctagaagtaattagagattttaactttagaaactctgggcagtataaactggtgttaatgatcacaacagaggcaaatcagtgtatttgttgactttgtaaaatgcatataaatacttatgaaagagtgttcagataaattaaagctagtgagaacatctaacgtctttttcaataattttctaaaagcaaacaagaaaaggtgtgtgtgtgtgtgtgtgtgtgtgtgtgtgtgtgtgtgtgtacgtgcgcaccaccatcttaccatcatccaaatggggggtttaaatagtctatcaagttaatgtctctgaaaaagcctcatgggtggatggatgaatgattccctatggattatcaagaaaggtatatcttttataaagctatttctagcatgcactgtagcatttccagatattatcttggctgaaattttgagaatttgtaacagtttgtgaagcaatgggaaagaggaatcttgtttaatgaaaaaatgtatataagcagtaaggagacaacccttagatattttgtggtcaattcttttaagtccatgggaaatttggatatgttaaataaattttttatataaagtgtgtctgtcaaacaaggtagattcatgtcttaatctcaacatgcaagaaatttcaaacaataaaattaccagagaaatgagtctctaagttaccaagagaacaaaatgaaatatgaaaaatgtttaaaacactctttaaaaatgtacatatcagattaatcatttcaaccaatagtcttcaaaatgtgacaactatttaactgaactgataaataattttattgtttctttgactttacacaacaaaatattattttcaataatataatacactaaggttgaaaatacaagcagcatggatgattccttgatattataaaatattctggattatagtgatacaaatatccagaaggggacatttgatttagatactttgtttgattcatttatttttatctatttatatttattgtttttttagagactgggtctcgctctgtcacccaggttggagtacagtggcacaatcatagctcactgtagccttgaacacatgtgctcaagtgatcctcctgcctcagactcccaaagtgctgggattactgtcatgaaccaccatgcctgactcaatttaggtagaaggaaaagagctaaaacctataatcacacaaaatataaattctgcgcatattatatttacttgacattagctttttttttttttttttttttagacagagtctcgctctgtcacccaggctggagtgtgcagtggcacaatcttggctcactgcaaactccacctcccaggttcaagggattctcctgccttggcctcccaagtagctgggactacgggcacgagccgccacgcctgactaattttttgtatttttagtagagatggagcttcaccatgttggccaagctggtctcaaactcctggcctcaagttatccacccgcctcggcctcccaaagtgctgggatacagacgtaagccaccgtgcctggcaacattagttttttaaatatgttaacatcatatattaaataaagaaaacatattgtaatatttaaataataaaagaaattaggttttcatttttctatgctaggttataaaagctatttctttattgttttattgatttttcaggttattagtgtaattttttcttcattaaaggatgtaacggtaatctaggttcatgatgtaaaatttagatttcacattaccaaaataattaattgaaaaattggccgttcagattgtctacatcagtgaatttgaatttaggaaacagtatctttaaaaaaaagcatattggaaaactgacataaggttgacatctttaaattttaatatgtaaggacactaaggatatttaaatagcaaaaaatgcaaggaaaatgtatattttttacatttcctacatattgtcaacacagtaacacagtattagactttttaattttttcaaaattagtttgaaccttttattcttgatttgcctccaatagaatattgtcttggtaacttcatttaatactttatcagctagtgtgttctaagcctttgattaatcagaaaaacataatgaatccatcacctttttacattttgattctaaaatgatgtaccttctgtgtttcatggaaatgggaggtggtgggcagaggaggtagaagggaaaggataggaacaaatccccaagcagggaatgttcctaagtccttgtcttattctaattggatcatctgggttcagttgcccacatgtggagcagtagcatgaaaataggtaattgaccacatcaacaagacatatttctctaagattatggaatgtcgagaagagaagggactgaggcttaaactaacctagtccaccactgtccatcttttacatttgaagaaacatgtgtcatgaggggttaaattacttaacacaactagtttactgcccaaactataactacaaactatatcctccatatctgctgacaattactttacattttacacattgtggccatcttttaaccatcagtagccccaacttccaggttatagccttgaaccaaaagtttggaaattacatttaaaaaacatttgtgaataagtggaatattcaaatattggcacaagagagatgacttcagaaaacaaacattctttcactttcaatttggatacatttacacacacacacacacacaaacacacacacacacacactgatggcttgctcactgatttctatctctaaactttaatgtgggtttggaggcatgtcttgggaagagttcttaaagatcaaatagaataataatctaaaaagacttagttctgtttatgattttgctaattatttaaatgtctgaagtctatcatggacaaacttatgtccctctcacagcttattatccatctacaggtttaaaaatatgcaatatgtgagtctataacttgaatgctgctagtactggctcataacagcaacgttgctaagggattacaccaaatagcactgtattatatttcaaaagatgtggctatttttatcctgaggaacattttatctacgtttaaaaataagaaaactgatttttcccgaagaataagccactttaccttattgtttaaaacttatcagctaaattggttggaccctatattcacacataccaccattgccccaaacctcaccataccactttggagattgagaactctataaaatttgctttgtcatctaaatgagcatttataattcttgctccgtctcaacgtggggcatcacatccatccagttgtctctggtctgtggcattcttagactcttcctctcccctaactttggatctcaaagaccaccaagatcttttgaatcgtcctcagaaataactcttgtgttttttccttgccacttccctagttccagcacttatcctctattcactaaactatcgcaatagcctctaagtgatctctagctccaacctctcctcattcctgttgttcctttttttttttcaccccaggctaccagtttcaccaccatcttctaaatcttaaggtaatttctctttgccttcaagataaagtctaaatttcttagtttgactcttcagaatgttggcccagtcggtctttcttgcagaaagtctaacttttgtccccttttgtaaaccccatgaaataatcacacttaaattctggccgtggtctgagttctctgtgccttttcacacctctctttcttgctgaggctgcttcttccttctagattgctttccctatgctctgcaacaccccttccttacctgttcagaaaactcatgaatatcttttcaaactcagttcatgttaccctcttgcggatattcctacacaaagaaggaatatttttcttttctttatttttttatttttttatttttattttttatttttatttatcgtccgagctggagtggaatggcgcgatctcggctcactgcaagctccgcctaccgggttcaagcgattctcctgcctcagcctcccgagtagctgggactacaggcgcctgccaccatgtccggctaatttttcgtatttttagtagagacggggtttcactgtgttggccaggctggtctgaaacgcttgacctcgtcatccatctgcctcgatctcccaaagtgggaatatttttcttttctgggctttcccatagctttcgtatattatttgtactctagcagttatcaattgcagtttaattatttgttttatgtgtttcccccattaggtatgttaggaccttgcacagtgaatggttttatatagatttttaataagtggtgagcttttaaatgtggaaataataatgaaaccttgtctttttagtttgtgctctctcagacaggatatatttgattttcttaataatctctttgaaacacacagagttagtgattattttacccattttatagatgatggaagggaatattgaatctcagaaaaatagacacatattcatgttcaaagatagaacttggacttgagccaaaaaggtctagtgatcttttttattgtaatgtaatgaaacaagagatactgtgagtataggttggtatgaggagaagcagcctataatttgagttaagattatgaagacagagtgaaattataatattatgaagagaaataacagttttgatctaacttatgaaaaaaaaacaacatgtaagagtgaaaataactctgatgggataaagccccctttgtaaatttagagaagtgcctctacagagtaaattcttaaccttgggttatgtggctctacaagattcattacatttggaggtaggcacacatttcttagagaatgtttatccaattctcaatgagtcttttatccacaaaatttaaggcactgtgttctaaagctaagttattgactgcttcactaagggaaaaattatgagaacatagtatactaatggagtaagattatcgttggggtggctgaaagtaagcagtttgaaatgggattttagaaaaatgcaacacttcagacagataaggtcagaggcttatttaaaaatgacaatccccagtgggattttaggggattacttgacttaaaatttaatttaaatataaggatagtaaagaacattttgaaaaaataaaaagactgtttttccttataagatagcagaacatatcatataggctattaattcaaacagcatgataataatttagaaataaaccaattattcaaccaactggataaatggtcaagaataaggcccatgcatatattgaaaatttagggtttagtaaaggtagcagtccaaatcagtgagaaaaggataaattatttaatataggataaattgtttaatggtttatggaaataaaaaatgatcattacttcattcatactataataaagagcactggataaaaaagattaaaaactcaagagaaaaacagataaaggccatgaacagaaaattcaaaaaggaagaaaaatgtatgacaaatatacatttgaaaagtttttctacctgacagacaaagaaataaaaactgaaacaatttttcatctatcattttggaaaaagatgaaaaatttaaaagaatttgagatggtatacagacatagccactttcttatgtacattttcagtgaacaatatatcaggaaatcaggaagtataaatcaggaaaacattggtgggtgatcaaataatatatatcaatattttaatgtgcatacttttgtcccattaattctatgtttagaaacttagcctaagaatataattgaataagtgagcaaagaaatactatattgcaatattacatataatagtatacatctggaaaccacccaaatatctttcaggacagaaattgtaaaataaatgatgatatatctgtattgagatctgtatgtattgaaattattgaaatgttattttaaactctacaagttgttatgtggaaaaagcaatttagagaatagatgacagaatatggtatcatttaccagtgtgttttcatgcatgcttatatttacatatatgagattatgtctatgtacatgtgtgcctatagttatgtatgtaggtgtatgtgtggtatgtgtgtgtatatatatatgtgtgtgtgtatttatatctatatacatatatatgtagagtgagagagagacagagacagagacagtactacatatatatgtagagagagagagacaaagacagagagagagaatacatatatattctgtctaagcaggaaaaaccaccaaactgttacaggtgtgtgaagagaggatattttgagaggtctttgattttgttttatgttctcttctcttactcaatttcctttaaaatgagcatgtgttgtttttataataagcaaaaatcatgtattttctccttttgtaaaacaatattttcaacttatttcgtttaatatatttcacttgtatttcacttgtttcttacccccccaaaaaaagcaaaggattgcgtttcataaaaaaatttagtaaaagataaacatgaggacatcaaagagaagagaaaatggcatgaaaatagtatgaactatgaaagcaaaaattcatttcattaattcctgagtaattgctagaaacgagtcacagactggttctgatcttcctatcaactaatccaaggaagggaacactgttgctttaagattcatatatcggtaagttaaaaaatgagttgcttggtaaaatatattgctattaactctgagaattaaaagaaatatttctctgtggtgttttataaaaaagatgctatgtgatatggtgtgtgcagtttcaacattttttctatacttcataaagtttgaaatagatataaatgtttcttataactgtgactgattcttataaaactacacattgatggcctgttgtctaagttccattcattgaaaatctatcagcactggagccccagttagcattcttaacagggcattctctttaagactgaacactaagtgtgcaccattaaaagaagctgcattcttcaacttggaaaattcttctagactcactctcctgtatcccacgttcagcctcttgttctcacctgaatacccgaatttgatttggatgctgtatgtgttctctggtccttaagattaaaaactaaggtcttattttagtttcttgctcaaatattgcttttttgacctgctctgttcctgtaactgtagccctcaagcaagcccaacctaattctcaagtgtggctcagaattctgggacaccagcccaaattgggtcttccttatttgtgatagaatggaaccaaaggaataagagaggctgggcatcttggctcacgcctgtaatcccaacactttgggaggccaagacgggcagatcacttgaggccaggaattcaagattagcctggccaacatggcgaaaccctgtctctaccaaaaaatacaaaatttatccaggcatggtgacacgtgcctgtaatcccagctactcaagaggctgagacacgagaattgcttgaccctgggaggcagagattgcagtgagccaagatcgcgccactgaactccatcatgagcaacagagtgatcctctggtattttttcttaaaaaaaaaaaaaaaaagaaggaaaggagaattcagtgttggtatccagctttctgattttctgacatgaacaccccattgtctcgatatttataacatatccacttccagttgaatgcaccaagataatctagttgcaaaatgtagccccattaaatacatggattgacacatttaaatataagccagttaaatgttagaagttacttaccaaaaatgaggttgatgttttagaataatttactcacagcccttctctctgaaagcaattagagtaatacatttttagtctatcgagattgtccaaattcatgataacaatattacctagtatgcaggtgtgcttccagctcacttggaagcatttttaaatcattaaaacataaagtaaaagtttggactcttctatacacacatttttattttactaccactcaatcattcccaccacctgggttttcagttttattgaggaccagtttcttgtctaatgatcagtaggcaggggtctctactgtccagaaatcatgtggttactcatcacggcagctgctactacagacactgaagaaagatcatccaacatggataaataccctgttcttatcagatgtttgagaagtaatagagtataatgatgcccctcatgtagaatatggttctaagaaacccatacttatattaactcagaaactgccataaatagctgaaatatccaaataaatcaacagacccacagtttgtgagaaacagaaggatgttcatggcttcaatgggataggccaaactttgtgttgaattatgtgcttctttatgtcttgtttcctctgcctgaaatgccttttcctccacacccattagtgttttataacacctactcatacttcagatcttgattcaagcatcacttcttttggtgaagtattttcagatctcccaaacctgtcataataccatatagtgctcctttatattgtttattatattttcaattacatgtttaattgtataattattgataaggccaatttctttcaccaaactataaactcctatgaaaataatgactctgtcaatttttctcacattcaaacacagtatttgtacattgcttgaactgaaagaattattaataaataattgaactccagggttaccaattttatgaagttaggaatatactgttaaaagtaagtagaaaacaactccaaattcagacaacctttaccatgtgctttattttattaaagagttaaaaaataactatacaatttattttatgtaaaagacacttcagtttacaaatgcaaatatcacctctggaaataaacctaaaggacaggaagtcattgaagaagtggcaccatggattgccaggatgatgatgttgcaggagagttatatttaaggagacggcaaataaaaaaatgataataaggacattagatactaatttcaatgttattttgtgttttgtcttatgattattttagtgtttatgcattatttaacatttattaataaattataaatactctggctcaattcattctgttagcttggtttaaacatatataaaatgcccacagctactcctgttattggcatctggtagttctgcatgacattaagacccaaaagtaaaaataaataaatttcttgactgagaaaataattgccaattcaaaatggtctactaaccttaacattcataagaagaagagtatgtatcatcatcctggcaaaatggcacttataatttcataaatgctcctttttaactttatgtattatttttattttgggggtagtaagatgtggaagctgttagatagtcattacttctgttgacatggaatattttataaacatgaaatatttcacaaaaaataaaaaaccagtaataacaggtcacatacacactcaataatctcactatagcaatatttcagaaaaaaatgtatttagggaaaacaatttatgtctgtttgtttttagtggcagtcatgacatgaggaccccagactcaagtgcattgccatttactccctggtagaatgtgatttcatttccaatgagctcaaacataatgattatatgtcttactaattatacaaaacatggtgaagaggtagtgtgctttgtgatgtcacatatcaaaaatgctttcttttaaacatttctatctccttagctaggtttaagagataacaagatgggccactgaagtaactttgtcaagcatgttcaatgtaatatttccccagagattgttttaactgattcgaccaaattagattattgacttgacaataatgaacaagatacccctttgaatttttgtcactacatctttttgtaactcatgaaaaatttcaggccaggcacagtggctcacacctgtaatcgccgtactttaggaggccgaggcgggattattacttgagctcaggatctccagaccagcctggacaacagaccaaaaccctgtctctacaaaaaatacaataattagctgggtgtggtggcgtgcacctctgattggtcccacctactcaggaggctggggtaggaggatcgcttgagcccaggggttcaaggttacagtgagctatgctcctgctgtgctgcgcaatccagcctgggcaaaagagtgagacctgtctcaaagaaaaaaaaaatcagaaatgtttgaacccataaagtagataatgaggacatagtgggagtatgtagaaaagcaataacaggccaggagcagtggctcacgcttgcaatgccagcactttgggaggccaaagctggtggatcacaaggttaggagtttgagaccagcctgaccaacatggtgaaaccctgtctctactaaaaatacaaaaattagctggacgtggtggtgtgcacctgtaatcccagctactcaggagactgaggcaggagaatcgcttaaacccggggagcggaggttgcagtgggcagagattgcgccactgcactccagcctgggtgacagagcgagactttcgtctcaaaaaacaacaaaaaaacccaaaaacaataacatatagcagtgttggccctcaagcagtctggcagcctttttattgctttggatgccgtttgtgtctaagcatttgctttaaatatttgatgtagttaattaatgagtattttggatcttctattatacaaatctgcctatgaaaaataaatgcaaacaaattacaaatttcaaatgatagaagaccaaacggaaatacaacgataatgtcctcaaatgtgcactagtagtttaacagaatataactgccatctgattattaaacagtagaaattgtttaagtagatagttaaaaactgtagtatctaatggttagtattttccaagacagtagcctaagagagtagttcaatatatacggagttccggctgtggaggatggggctggtaaggaaaagcaagaagaggaaataaggctttgctaaagattccttaacttccctataagatgttacagaggcactgattggttttaagcagggaaattatgtggatagttttgaattttttaaaacttactttggtagggccgggcgcggtggctcacgcctgtaatcccagcactttgggaggccgaggagagcggatcacgaggtcaggagatcgagaccatcctggctaacatggtgaaaccccgtctctactaaaaacacacacaaaattagccgggcgtggtggcaggcacctgtaatcccagctatttgggaggctgaggcaggagaatggcgtgaacccaggaggcggagcttgcagtgagccgagatcgcgtcactgcattccagcctgggcgacagagcgagactctgtctcaaaaaaaaaaaaaaaaaaaaaaaaaaaaacttacttcggtagatatgtagaccatggagtgggaagaaattaaaggtgtgatttaggtgtttattgcagtaaaccagatgagaaataaatggtgatagtctgaaactgatgctgtggcagtaaaggatggacatggcagtaaagagatgaatttaagagaggttttttttaaaagtggaaatgatagatcctgtcgactgactgacttaatgctattagataaaataatttttaaattacatgtatttccaaaaagtacaattaatgaatccatggccaggcatggttgctcatacctgtaatctcagcactttgggaggccgaggtgggcgaattgcttgagcccaggagttcaagactagcctgggcaatatagcaacatcccacctgtatttgaaaaaatagtaagtaagtaaataaataaaaatccataagtatttggacacctaaggtaaatttaaaatcttgcagttttgttttcctttgttctttgtaatttttagcttgtttgagtgggggaaagtttgaaatattgggtaaggcaaacatttgaaaacgctcatctgcagaggaaatttgcagtgttgtggatagatcacttgtgtcaatatgtgaagcataacaaatgctttttgattgtgaaagcataggtagatatattgcatttcaggtcaccactaattaattgcattaatttagttaaattggttttctcaactcatctgaaaaagatgaaaactaacacttcaaactacttcctacttggtaacatcataaagacaaatgaactttctttttcagtcatttccctccttcccctgttctgccctctctctctaactaggaagctactacaccagcctttccagctttggttttctaatcttaattatttctgtacccatctatcactggaaattcttcaaacactgatgtgtggatgtttgtgtgtcgggggttgaggggtgagtttggggagtggtgctgtgtgttattgcaaaattatcctttttttgctttatctttaaaaccttttggaaacttgtctaaacttttctttctcttttttttggcagaatcttgctttgtcactcaggctggagtgcagtggcgcgatcttggctcactgcaacctccttgtcccgggcttagctgatcctcccacctcagcctcccaagtagctaggaccagagttgtgtgccaccaatgcccagctaatttttgtatttttttgtggagatgaagtttccggagatgaggtttcacgtgttgcccaggctgctcttgaactcctgggctcaagctccgcctcccaaagtgctgggattacaggagtgacccaccatgccctgcaaacttatctaagctttttttttgttcttcttctttttttttttttttttttttaggttctggcatacatgtgctgaatgtgtaggtttgttacatagatatacatgtgccatggtggattgctgcacttatgaacatgtatgtttattgtttaagcttttttatcctttttatcaattgtatgtttttaaaaatctctgccatgtgcttttgcctctggctaattctatctgcatagacaccataataatctgttaatcacacttaacaagcctttgcatttgatatacctcttacaaacaaccaaacgaacatgcaggcaaaacaaaacagcaacaacaataaacacttcatagtctttcttttgcttgtttctctaggatgactattcttaagacccacacctgacaagaataattctttaatttttcattttcttagaatcaaggtattgtgttttcatgtagagttgtaaatatggtataagcaaagatacttgctctcaaaccaggattttatatatattttcatattttgtggttctatgtatgcatttttggctctaaatatttgttttcataataccattaatgtgtaggacaattactatgtatttttgttgttgttgtcctatccttttcctttcccttcatcttagtattaggataagtatgcaacagtaattttccctttctatgagataaaaacttctacatcttcctaagataatattactgagatagccatttatagatcattatttaaaaagactttttcatagtgcattgacatacactatcccaattgttcctcatatagaagagttttaagttgaagagaaacataatcaatgtcctctagaaagattcctcttgtagtagcatagaaggggaataaaaataaagcaagacagaaggtggggggagtccagttgagacattatgataaaaatccagtatagcagatagagtcataacttagagcagtggaataaataggttgatattattaggctaggtttgtccattcttagcaatcaattagaaaaaggcaggtggataaagaataaagagatggaaatcttaaggtatgtactcagccaactgggtgagtgatggtagcacttaccaggtcaggggaggaaagctgaagagtttgctagtgaacacacaaatagaaatgttcagtagattattgtcatcatcatcatcaccatcactatcatcatcattatcatatttcctcagcactatcatttattaatttgtgaggcttggtactcctagaagctttgcacagatcacagttcacttaatcttttcaacagaccgtggaaaatatacccttttctctagatgcagacctggaaaatggaacttagaaaagttatagaatatatatgttgttgttgtccttttaagctcagtgtacatgtgcaggatatgcaggtttgttacataggcaaacatgtgtcatgggggcttgttgtagcgattatttcatcacccaggtattaagcctagcatctattagttatttttcttgatcctctccctcctcccaccctccagcctccaataggccccagtgtgtgccattcccctctatgtgcccatgtgttctcatcatttagctcccacctctaagtgagaacatgtggtatctgtttttctgtttctgtattaatttgctaaggataatggcctccagctccattcatgtccctgcataagacatgatcttgttctttttttatggctaatgctagaatttttatgactccaaagttcaggttctttcaatatatcagattttaggaactcagaagaattgagagaatagtgtggattggttggaagttactaggaaaatatgatgagcatcagaaagaacacctaaataagggatgccagtggggaaaagctcaaggatggaagccagaggtgcaccatttaaagtgcaaggaggaaaagaggagtcagtgatgggacctaaggaggaattctcactctgtcctttttcaagcaggatacagattccttcttttttttttttttttttttttttttttttgagacggaggtctcacttggtcacgaggctggagtgcagtggcgcaatctcggctcactgcaacctctgtctcctgggttcaagagattctcctgcctcagcctcccgagtagctgggactacaggcgagtgccatcacgtccagctaatttttgttatttctagtagagatgggatttcaccatgttggccaggatggtatcaatctcttgacctcgtgatccgcccgcctcggcctcccaaagtgctgggattacaggcatgagccaccatgcccagccacagattccttcttgtgttcatttgaaatgtgaactctgaacaaaggacagtttatcttggatagtcttattccatgatttatatatcactaaaagagcagagaatctgtagatattataagtgggatccttaataattaatatatggaaagagaagcttaccagataccaggatttttctgcattgcctggaaaaggaggatatctgcaaacttttgtaccctgtgcacttatcagattggacctcagatgggacctctgccccacagaatttctctttaatgactcattgcttactggtctaagaagaaaaataattatagcctcaggttagaaaaattgaaattgaatcatttcacagtcagattaatgctccattagtcccatctatatgaaagggaggagggagtcaccaagtcaggttggaaattccttgggatgattgaatgtaagggagaaaaactgtgataattgacatagtcaaggcaagaacccagttccgaagcaaatattttctttgtgtgaggaaagggtacagtattgctggttcttttttacatataatattactttgtattctcccaatactttatttttttttaaaatggataagaaatcataaccagtagagagagtaaagaaacacaggtctattttctttaatgaatatcatcactcttgagttataactctattatctacagtcttgttaagtgaaaattgtttcctcaataagaacacttttttatagaagttgaagttctcttctggcacacattagaattctccagtattcatatttcagttttattcatggtgtcaaaaggaattgatgtgataaaatttccaataatgcaatgagaatattcacgtttgtgcaaataccatggagatgttgagaagtagagtgaagggacattatgtgaaaagtaacatctcactggactcaccaactctaaatcttacttttttcttcagagatgaggtctcactctgtcactcaggctggggtgcagtggcatgattatggctcactgctactttgaattccagggctcaaaggatcctactgcctcagcctcctgcgtagggagccatcatactcggccatttttttaaaaaaaaatttttctgtagagacaaggtatcaccatgttacccagactgatcttgaacccctggctcaagcagtcctcccacctcagtctctcacagtgctgagattacaggtgtgagccaccatgcctagcttaaatcttgcttcttatatatgcaattattaacaatagaaagctgttttgtattactagattacttggtttttcaaaatttcaacaactctttttgatttttaagaatattggttagaatggaagtattggcataagtcactagttttcaaaaacatacccagcagagttgaaagcgaatgtaaaacgccatggcctgttgattctatcatcgtatagagtatttttctgcttatgtacttttattgttttggtttagagacatgtatgatttattacaccagtattttaaagcacattctccctcttcatttctgcaatgtactgtgtcgaaccaacttcataggtaaaagttgtaaaatattgctaatttcacatggttcagcctaatagaatctcatgcccttttaagccttggagaaggaaagcctctcatattgtctccttccagattcttggctcaatccaagcttctgcatagttggagtggcaaatcccactcctgcatctggtgagctgtgcagttagcagctctgacacttttctacgctgttcaaacaattacagccccaaaatgtgagtgtggccttaaaaaaggctgattccatgtgactaccagattgcttcaagatctgcccagtcatccccctgactgtgtcatcccttaaaaatctgtgtcatctgggtacagaaaattagaagaatgttctcttgatctctgcttaaattttcagaatttttcctttgaaaccacgaactagagaattggaattagacttaatgacttgactctatgtagtatatatttcttttctccaaacactgttttgtatacatgaggagggacaagaaatgaaggaaggggaaaagtatagcgtttcagccccagaaaggtacctttcacaatgtaaatgcagagtatctggttagacatagccattttgcgcacaagcacattcagagatgaagacatgcagtctctaattgtttcgttgtatctaagagggtgaaaatagaggtggcatatgaaaaaaaccttccattttcattgagcgtacccatattctatggcatttcttaccagtcagtaggagttttttttcctactgatcagtactactgaattacccaaaggcaaaaatattccctattgtttctttgttttctaactttgttctctagcttctaggtagatgttaactttttggtatttaaatgtgcacactccctgagaccaaactgcctcagcaagttttacttcaatattaatgggcaagatgaatattgtttgatgtttcactgttagcaaaagggaggagaaagaactagaactaagttcaattgaaccattactatgcagggtctatacagtcatgattattatctcagattccaaattctgtttaccaaaaattatgattatcaaattgttaagatagtaaattttatgtgtatttttaccacaataaaaagttggaaaaaatgatttgactatatccaagtttgcagagttggtaagtagctttttattgcaaaaaacttgctgatttgtgaaagaaccttcatttccaaattaggaataatttcctgcaaggaaagactatgctgtgtgtgtgcctgtgtgctcttgtgtgtgtgtgtgtgtgtgtgtgtgtgtgtgtgtgtgtaactcttctgttgtgaatccatcagtggttttgcattgtttacaggataatgctcagaatccataacaaggtcagtaaactcatctatcatttcctaggcatgtctgttatctgatctctagcctttcttctcccatcgtcgccaagtttagttctacttgacttccttcacttccttcccattgacctagggagcacctctaagactgaaagggaagtcgtgggcttggtggagttgaggtggggaatctatgaacagataaatcagatagaagcattgtttggtagaaagaagagctcatgagtggcagtagagattgagttaaagagtgggatgaaaaagaatcaaaaggaagtagtacgatttggtgaccaatttgttagaagggatgaggggcagtaagtagtcagtgatgaccccgaggtttctagctggacctagaattgtccaactagtccaaaaatgaaaaaatttgcctttaactaagatgagtttgacaaaagatgaagtaaatttgagggtgtaggtaatgaaaacaagttggctttttctcccttgatggcaaatttcagtgtgtatggatgtatacatttgtgtatttgtgtgtttgtcaatacccattgatttttcttaggttatattcaaatactgaagttgtactaattaagcaaccgaagtgtatgctttcagcatggtacctttcacacagcaccaaacatcattatattattttctattgtagcataacaaatcacaacaaaattagcatcttaaaacaatacacatttgttactttacagtttccatgggtcaggagactgcacttgacttagctgggttttctgttcagggtctcaaaaggctttaagaaaggtgttggccaggattggggtctcatttgaggttctggctcctttttccatatcaggtggctgttggcagaatcaatttcttaaccactgtaaaattccttgaagcttgtttcttcaaggtcagcaggagaaagaaactctgacttctgacttctaggccattttttggagagctaatcacttgcttagaccagaccaaccctgaataacctttgattaacttaaagtcaactgattaaggatgctaattacatttgaacaatcctttaactttgccatattccactggttaaaagaaaattacagatgttgaccatctgggaggagatagtgtaagggcctgagctattggagatcatcttagaattctgcccaccacaatcgtgttctatgtttatgcaggtatatgtgtgagtgtgtatttatgtgtgtagttaataacttaaaaaatgaattacatgtatcccaaaacaagcggcaactgcacatcccatgccttcttacttggattagtttttcctgaagttactccagggtcctgtcttcccattgttaggtttcctttctgctgtcctggcttcacctttcgtagccaagaaagcactaaatttggctctgaaatgtacatttcagtacaatctccctgtcttggcagcagtggtgaggctttagcaaatcgtttgtgatcccaaatgagcttcagcagtttggagtgaggccatggcccacatgtttgatgccaccagcctgatttttgtaatgaaaactatatcaataaggtaagtagtcccttcttaggcatgcattcttttccaattttatgtagtggtcagtcattcttacagtgatacaaataaatatttatgctttcatgtcttttaagcttttagcaacgttaaaagaaaaggagtctgtaatgaatgaaattgtcccattgaacttattttttcagcttttgaggatatatcgagtgtacttcttaaaactgaacatgtgcatttgttacatttatatatgtttccacatatcactttgtaaaagaattagagagagcttatgaaatagaatttaagttgatttggtatgagcaaaatatattgttggaatgaagcaaaggaaagaaagcataagagccatcatagttaattctgtttaacttgttttaactctatcaaggttgggccaatgtggcaatttattaaataatttgctctcattaatgcaaaagaagaaatgttccttagggaaaaacatgttgtcttgggtacaaaattccagcaatgttttttaccacatgagactttatggaaaattccagataacagaccttgccctaatggtatgtgggcaacaaatccagaagtatctatcatagcattctttcttataacaaattttattagaagccaaggctagaatgttgaagctggactccgggcaggtgattcaaatgccatactattactttcctagcatggacagttctggttattaactcactcttacataaaacttttagaaccagaggattggagggatgctgacattccttagatatcttaggtaataatcctgaaaattcacttttcctgaagtttttgatagcagatagtaagaaaatttcactttaaaactcactttgaggacctgaaatgttatattccactttgctgattgaggtcaaggactattgtttgaacctcaaacaagcaggtggtgaggttcactttcaactggtaattacgagaaaacgaaccattatgctagatgcaaggccacctcatcttgcatccggtaaacatgccaacaaaaacacaaacaagtgtctgtaatacctttcaacagctccctgttgctctcattataaatatggaaatccttaccatggcattcaggaatctgcatgatctgatgcatgtgtatattgacagcacatcttgtatcattcgtgacatcactctctattatttggctgattttgacctaattcagcacttggaaaccaccatactcactcctgccttggagtttttatgcatactgtttcctctacactgaataatacctccaaaccctaccgtcactgcctattaaccccctacttctcctgtttctcagttcaaatctccctttttctgattatgtgtctctgattctccaaatcttgccagttggccctgttagggactctcagagcttactgtagttttatttcatccatagcagcttatgagatttttttcattaatgtctattagccagatcgtcagctccatgaaggcaggttgcaggcttgtttttctgaccactctatcatcaacccagagcacaataaatgaacataaagtgaattcaataaaaatgtgctgaaaggataaactactgttatttactacattaattacaacttttgttagccccttacaaaagatgctttcttagatgctgcatttcccattctacagaggttgaataatatgactatgatagttttagaggagatgggaaatagtttggtatttcttaaattaaaatatgaatctgttagagctagaattttattttctgaaagataatcttgtttagccagtgtgagaaactacattacacaaagaacattttgctagtattatttcgcaggagaactaaacttggtaaactgtcgttcctagaagattgtttttatcaggcaccgttgccttctttgagctttatgaactcatgttttaggacagttagacattactgatggagttagagaatactagaaagtgaacttcagctaaagaaagtgatcttttttctctaatggcaattcagttgcaaagttctatttttattctaaggggctcatagagggtggtccccaggattctcttaggggtctgtgagaccatacatattttcataataacaccaacatgtcatttgtaattttcactgtacattttctcagcagagttctccagaagctatacaatgtgatgcatattatttcataacagattgaatacggaagcagacatgagaacctagatgtcttccattaggtggcacaaataaaaaacattgtcactcttctcacagttttttggaaaatagttatttttaccgaaaataaatttattatattttttgaaaatgaattagtaaataaatatttataattgtctcagttttaagatggcaaatattccacataaacaagaaatctgtgagtcttcaataatttttaagactataaagagattctgatacccagatatttgagaatcacttctccgagccattttattgacacaattttacttgactttgcaacctgaccgttttagataccttttctttccagtcttttctaaaagatcaattgattaattgggttgactcgatgatacaagcacacgatcttcagtatcaaaagatactcatgaccagtaaacccctctttagttctcaattatccaattccctttcctggaggcaactgctactcttgtatttcctaatggagatcttttatgtgtttactcaaatgctaagacataatatatcatattctgcttcctgcttatcttccctaatgatatagcaaggagattgattcctaactctgcatgcaaatctgccatagtgcttttagcaattgcagtatcgtccatgatctggatgagacataatttcaccagactcctgttggagtctgttggattgtttcccatcctttgtcactacctacagtgtagtgatgactattcttttacttatttgttcatgtaaagtaaatatatctctagaattaatatttggaggtggaattcccaagtcaaaggaaggaaatacatattttttaaaaggattttagtagattgttctgaaaaaaattacaccaaacttaccctcacatgactatttttgctttttctcagtatactttttaatagattgcattataaaattttaatatttaccatttaaataagtgaaagcaatgtctaattgcagttttaattttatttttattaaggaagttaatcttttttttttagctgaagtcgaaaaatatgttcatctctttttcattgaagctcattagtttccaaaaatgtgtcctcatttcatacaaagtatctttgaaccattgccaggtcatagaagtgactcttgaagatcttcttctctgggatcaagggtcacatctcgttctcctggcttcatacccttctctctctacacatctcaattaagtaagcttcctttcttatcctctgaaattataatcatctttaggctcccagatataggtgacctgtgccatctagtctgacttccagtttgcaaattatcttcaaaaagtggaaacagcttttactttctactttataaattcatacgtgctcaggaggacttttattaagattgggacatattgcttagttagtctctagggtggaatcataattaatgaaagaactctgtctgatggaaggcttagtctaacaaatcatcctaaaacttcattagacattgtgtaatccccatggacactgttgaagagacacttgattaggcagatcgtgacaacttcagctttgcccatcatacatcctccagagactcctcaaactcaagacagactttctacaggaaggaatggctgtttctatttcagaatattactgataccagagctttgctgcatcttcatgtactttcctttatttttatttttatttttttacagacaaaatcttgctctgttgcccaggctggagtgcagtggcatcatcatagttcactgtcacctcaaactcctgggctcaagtgatcctcctgccccagccttccggagtgctaggattacaggagtgagccaccacacccagtcttcatgtactttcttatgtaaatttattttgtttgagattttctttgtgatggaataagcaattccttccttaactcatttcccgagacatttttggaatttgcaatatatatgaaaaagcacttattctcagtgatggaaacaccattatttcttttactagaatgtgatcttctggttttaatatttatgtctctgtgccaaggtgaaaatattgtagaaatgaaagtataatgagagagaatccagataataagattttcaataaacaaaaaaagaagtatgtataggagtcctgtctgctgcaaattttaagaatggttttctgtcaacatacagttgtcattgcttactgaaaacttctataaaaaacaagacacaaatgattgagaagatagtagagactgaaactagaactgttgatttaataagctttcttactcatatacttaatccacagtaaattattagcaaattacattttcatagtatttcagaattaaaagatcatagtcagggcttaaaggaatccagttgttttaacagtgctggaggcaaagcgttctagcagcaatcacctgtcagaatgacttaggttggattgtttgcaccacacactttactatagttacatgtctttcatgtccctttgtatctctgactcagtttcctcatcagtggtaatagcagaacttacattttagtgggaggattaaaataatgtacatgaaatcaaatatataagtcagcactcaataaataatagtttgtcatcattattactatagtaaatgaccactatctgaaatgggatataaaaaggaaagtgaaattactaaataaatatgagcgtacaaagacctgacaatttagatacaatatactcactctgtctcaaaatagtgtcttctgaagctttagtcagaatattatggtgacatttctgctagatttgtcattgagttgctgggtttggggaagaacctaggctacacatttctcttggctctacaaaaggctgtggcagtgggtccctgagtaaaccaccagaagaaacctaaggggcacctctgtttttcagttaatcagttttagctcaactgggatttaatcctgaaaatctaaattacatttacagactttaagttattgtgaatatttacactacatgggagaattaccaaaatatattcgttactcatacagttttcgaaaaacaggtgagacatcttccagttaaattcatcttccttttatgtttaatctattgaagaattctaaacattgttttgcaccaaattgctcccttaagttttaagagccacctagtttgggcatcagatgttctcctttatttctgtaaaaatcttgcaaattcactcccagaaagaaatgtagagaatactaggctatttcacagaaaaggcttgctgccctttcctgataacaaggtagttattattcttggctgagcctgtcccagaaagagtcttaggtgacctggtgtgggaattgctaaatctcaggctactcactgagactgtctgctgctgtgctgggcactgcagtcctccagagcaggcctgtcagcatcctaccgtgctctgagtaggtccactggggaacctggtggagtgacatcatgtatcagcctctagcagcaactcctctctgtagccccatgtctttcctgtggtacaaaggaacaagtgctacagggcatgtctgtaatcgttatcccaagggcacgctccacaggcatctaagggtgaaaggtactgccagtctgttgggtttgttatttccatagagctacacaggaaataacaccaccaaaaataacacattcaaactcagagggcaatcttccctaactattcataggcacacgtcaggcattctatacatatacccagctctttgctaagcatagtgaaatgcccttttacattgcaattaattattagccaacattgaataattattggtgagagggtaaagggcaagtgaaataaaaatagagctggtttatttttaggaagacactattttaatgtgttgattaatcagacaggtgtttaaaagcatttgttagagtcaattcacagaaaatctcttttacatgcaggttacagccaaagaaagaaataatagccaacacatttacgatttcaattgcaaaaattgtcatatttttgaacttgtgtgggtatttgaaaatattagctcctactaggtccagttaaagcttttaattctataaggtttcagactaccagctgaccactgctcagcatcccctggactccaagggtttcatctaagacatctaaggagaatgtctacccgcacatcgcactaatgcccatgactgcactgcttgaaccatgaggttattgaacagaaagcaaatccttttctgaagagcctccaagatgtggatatttcagttaatttcagctccctgccagctcagaagaatgatgctgtgctgtgtgctgttcccatgaatactacacgcagggcactgctcagtgactcagccttccagggagccagtcagggttttgaagctgcatcgtccctttcatccttgaagttcttttggatttcatcaatggcatggagggatatttttaaaacaatggagatttttcaggactggcaaaagggctcccctcgtcacagtgccaaaaccatcacaaacataagttatgttaaaaaaaatcctaaactaaaaatatctggtacttagggaactaaaagacatctcatgtttgctatcatttccatcagagctcaggtcaatggacagagatcaataccaaaacaaacatgcatacttagagcataaattcagataaatgctggagaattaacatgtagatagaagtaccatcatgcctaaaacaaaaactcagtccaatggttgtttcagtgaactgactagccttcatagagaaaagtttattcttttcaaactgaagttaaaagatattcggtgcttcattcgaaattttctatttcatgatttttgaagtagtgatttagaactctttaggactatagaaaatcatttttcttctaaaatgttgtcttagtcctaaattagaaaaaaaaatagtaagaaattaacaaaacaaaaagttaatagtattattcacatatataaataatgggccatcatggtatctgattttgataaaaggaaaatatactctgggattatttttccaaattctggcactctatttatgagtacctagacagacactagagtctcatggaatttagtattagaaatgctactttggagtacatttgatgtcattcaagttaaaaaattaaggaagtagattttcaaaataggtagcataaaatgtaaaattattgaatgttggagcaagaagatcatctaatgccctagcagttcttaatgttgcttgggtcatggatcccttaagaacacgataagagtttaccttcttcctccctagaaaatatactgctttttcttttataattaaaacaataatatgaaagttaatcttagtccagaagtcctaatagcccaagaatagaaatgtcaaattcatctcatatcattagtttgtaattttccgttgcccttttaattccaataacacagaagctgtaaaactgcttgtcatctgactttttatttgtcattacccaattgagcttcttatattacagataaggaaattgaggcacagagatattaagaaacttttccgcaggaaaaaaaatctgctagttattgagctgggattcaaattcaggtagctgattctagtgtgcatgtgctaaccacagcacatactgtggctaaccatgcctacactcatgctcaaaactacgctgtgataggtcttattagcatccccattttacagacgtggagattgaggtgtagagtggttaagtgacctggcaaaggtggcaaaactagcatcacagtcagccagtctggttccagaggtaggaactaaaccaacacactgcccttcacatgcctgtgtgtgagttcgcacacccacacaatacatgaatttgtacatatgtatcttagaggtcagggtaagctgaggatacgcatgacaaatgggattagatatgactttttccttctttctttcttagttttctaattattttgttttaagcaagcattattttggaataaaaattataaatattatttttaaaaagcaaacaggttgataacttaaaatgtgttagctggtgaaacgtccagccttatggagtaggcccctgaggtatagaaatggttttgatggcataggatgtagccttgggaatgtcctggaagagtaggagcggccagttaggcattaacactcaggagtaaggagactgcatttgggatgctcagctgattggagggtggtgttgagtggtcccctgggcagtgagaagagaggccaatagcactggcacaggaggacaagcaagttgttctaagtaaactctcaaatgaactgagagataaaaactctaaatttggactgcttcacaatttgcctaaggctggccctactcaggcctttgccagctgttgttttcttttaagcctctgatctgcaggaaaacagtcctgatttcacaaagctttaacagaatttttataaacgcagatttggggctccatatccacaaagttttccatcctttattttgagaatctgcatatttaacaatgatcctccccaaggaactgcaatgcaaatgtccaaatacagtccttggtaatatgtgttttcacagggtgaagtttttgtccaacactgtgagatgagagctgggggaaaaaaaatgaacattaaccatagaacaggaatgcaaattttctgaaaagtagagcgctactcctctcctctctttttctccatataattgaagagacactcaaattgattgttttcccattgtttcgaatggttgctccatgtaattactgaactgaactggtagtttggggggaataggggaaattcagagaatgttgtgtagaagtagaagtctacctatgtcaatgacctattttagcatttttctctattaactggctaacaattcgcttggaaactcctccagctgaggctttgttaggctttgctgaaaataaattaggtgactcattaaattgttgctggagttaaaaaaaattaggcttattgattcttaaatttctgctaaaaatgttgctaaattaaatataggttattgtctttatcaaaacaaataacccacagcttctgtattgctttatctgtattcaaaagtttgggccgggcgcagtggctcatgcctgtaatcccagcactttgggaggctgaggcgggtggatcaccagaggtcaggagttcgaaaccagcctggccaacatggcgaaactccatctctagtaaaaatacaaaaaaaaaaaaaaaattatctaggtgtggtgttcgggtgcctgtaatcccagccacttgggaggctgagtcaggagaatcgcttgaacccgggaggcagaggttgcagtgagccaaggtcgtaccattgcactccagcctgggcaacagagcgagactccatctaaaaaaataaaaaataaaaataattaaaaaaaaaaagttcgaacaacaaggttatgttagcatttatcagaaactaatgataatttatgtggtattaagtagggtagtatcttgaatgagaaagaatactgtagtttggattctttggaggaccttcggtttatattttatttgcaattatgtttatgcttattatttctgcttactttgtgactaaaagccagttaaatgtgattctcagatttcattttcagtgtttttattagaatgtggtcttttaggatttaaacctattttcatcttgcaagtatatattttaaaagtgattcatttaaatattctgctcagcaattagcacaaatgttgtcactaaattattacaatagtagctattaacttcaataagtaaaataacagttccctattgtataatatatttagaaaaaaatcacttagtggggtgcatgtatgtggaacaaggtgaagactacctatctcatcacagaattcctcaattaagaagaaagtgctcttaattacatccaatggcatcattttcatgaagataatcaataacaagtgacttatttcagtgtctcaaattttcaagtttatgcatccatctacttcacagcatccatctccatgggccccaggctgattcttgttatccttgctcaacctatccattctcacagtaaaaagccatgagagccattattttttaggaaatgtgacccattatccccaaatcactgggaaaatcaccttactcgacgggtccttatagctatccctaatatcttgttgatttctcctttaacctttttactatgccaatgaaaatggagcaatgtataactcaataaactccaattcaactgtcaaatatccctttcttcccaaattctgtttaagagtctgtgggcctcttccaactacaatccctgcacacccatccttagcattagccattgtacttttagaggaccaatttgtaaacttgatcatatcaatcttgaaatctaggaacaaagaaccaaactgataagctcttatatccacactcaggagctcatcttccctgattaccttgggctccaagtaccactttcatgagtgcctcacttgtgtagaatctcaccatggtacagctcatcacaccattttattatccagcagtggaaatgtaaattcatatccttttaacactcacaaaaggagtcaatttcagtcaatttttaggaaatttggtgaaaatttagttggttattatcctgttcttcaaaaagcacatcattagacatacttttaaaaaaccagagaataatcttaccttataaagacaaatgacacatgttgctatgagtttaggggagggttactaaccttattatcatgtgaactgtttggaattacctttgaaccctctatacatggatttctgtcggaggcctaagaactccttgtcaggagaaggaaatggtagaaatcagatgaatggtgaagtatgaccattagaaaccaccctctatacacctacactgcctatttttacatcaaacatagcgaactgtcctttaggaagcagaaaaggcagagctgaggaaatgagaggcacctctcatgtctttaagaaaacaactaagtggcaatttctggaaaataggttattgtttgtcaggtattagcctgaaattttgcttgaattgtttctccctaggaaatgaaagatgttcacttcttagttgttttggaaaaacaaatacttactaaagattataatggctatcaatttaaacaaacagatgcttttagtgtctttgtgaataacactagtgaatttgcaagaattattgctttaccaacaaagcataaattcccatgttgcttcagtacttgtgcagtgtttgttctggagcctctattcaatatcaaccagcgtatagtagttcctccgtgagagtctcttgtaaaaacttacattcattcttgttattattttatctgagtgaatatttgacaaagaccaaagaaatccccttgagactggtacccattttctctaatttgaaagatattgactaattttgttagatcccaccatgaaggcaaaaggaaaatatattagctatcactgtggcttaaaacaagaaattatttattatttttaacaaatctgaggggcaactggtgtttggttgatctatgttgaacttatggatagttatgtgagtgtcagatagaatcagacatctatgtgagctggcgcatctccattccacattctctctcatctttcttctgggactgatgagcttgcctgggtgtgttcttctcgtggagatggaagaggtggaagaaaacaagcccaacacaaaagcacattttcaagtctctgtcatgacagttactgacatcccgtgaatgagggcaaagacaagcagtggggcaggtcctcccacccttgatgggagggctcagaatgaatacatagatgcaaggagtagggatttggggccagatgatacatcctaccacagagaggtaggatacagggaaattctaggccctccagtccctttgctccaaataatcaccatagttgagacttgaactatgagagcatcaagtaggaatgccaggtgagcttcagctgctgcccaagtgtctaagaacactcattcacctctcagatactcacatacctatgaaatgcaccaattttatatcatgagccaaagtaaaactcagaatcattgaaatatttgtctttgcatagaaagagtcccatatggaaacaacccagcctacctgcttgacttcctgcctgcctgcatgcctccctactccctccctccctcgctacttccttccttccttccttccttcatctctccttccttccttccattctccctacttcctgactgcctatgtgctttcctccctccccccttccctccccccttccttctttccttccttccttccttcccaccttccttccttctgctctccctcctttcctccatttctccctctctcccttatatttcttcaattcttatcatttgagtatctagttaatgagttctcatttgatgttatagatttttttagctcttcctcacctgtattccttggagtaaattttatgaatcttagaaacagagtctggctgataaatttattggtgcatcaaactcattgagaaatgtcttccagtttcatcttccaaaatgttactagttctaaaggtagtggttgatagttcacacaaaaaaatcaatactgattcagaaataacttgctcatcagggaaataaacctggaaggttttagtcataatttatttataatccctccctttgtgatattcagagatgaaatttgaggtgaaaaaattcaagtattctttttcatatattttgaaaatataagagtctttgatgtattctgggagctagcatcttgaaaagaggaataaaaaatgacttatctggagttaggaaggtgctagtccatcacccataaaccagttaaagagataaaggtgatttatcagaaagtacaacaaaagtgataacaatagaatattattctccataccaagcaagttacaggtatcccctgctctggacaaatgcgtgatgtgtaaacccagattgaccaagggcataagggagatgtagatctgtagctttagcacacatgaccaaggtggtgcacttggtgtaggctctcggctgattgctgactttgcacacttgcggggcatttcatgaatctaaattcgggaataagatttagaagctggcagatgacgaagagattgtttgggcaaccaggactcttgtatgtgacataatcaatgctgaagttagttcatcatcccattccttgtatttccaaatctgtgatgcttagggccttatctagtgccttttaccaagtgggtgggttgtagaaaaaaaaggactaatactcattttctttgaaatataagcttttgaaagaatattttaaaaagaggactaacattttagctttcatgtaaaagtttgaaaaaatgcaatttcagtacttggaaatgagcattttaagactccttgttgacttcccttgtattttaatgcatttctagagagatgtctgcttctgcattgcttccccatgatttacttcagttgaaagttcagccagatccattattttctttctttgacacattatgcaaattaaatgcaaaattcagtgatgagaggaaaaggtctcagagcattgagcagatgccgtgtcggtaatagagtaaggcaattacaaaattacttgcagccactgtgactgtgtattttcccgtattctgaaaagaaatctgtcatgtgctcatcactacgagatttatttttccattgatgtgtgggagatttatgcatttaactgtcgtacacattgatgagagaaacatgcacctacagaaataattttttatagattagtgagatatttaattctgactttcttttccactaaaatgatcctttgtaatagtcttctcttcgcctgtattgtaagtatgaacatcagaatggctcagtaagctggaagagcaaaaccatgtctgtgtgtagaattccaatgccaaaagagaaataccacttatcttccacttctataaataaaggcaatagcaaagtcattaacaagagcaaggggtgaattcaatgatctctaagatttttttccagctaaaaatgatatgattcttatctattactaggaaatagtggtattgaagtagaattatgagctctacattcagtctacttttcacatcggattgtcatctcatttttggagggtaattctctttagattctctagtcctaagctgtaatatgtcttatagttgtcatattttagtgaacaaaccagaaaaaaagattgcctgcatcatatgtaatttttgttcaatccaagggcaatatcgtagaatacttgactcatagtttaaaatgatcatttttattgagttcaaattaagtcttctgtagatataataattatgtgaatcaaaaatatgtatttgtgtgaagaaatgctctttcttttcaggcttgccttcaaaaaaagttagtctcatactgaatggcaataatttcttcttcctgcctcctaagaatacattgaggatataaaattatgagactagaatgctcttatttcaaaaacattcacagtaggcattggcctgagcaataattgtgaatgtttcatatttagagaatgggtagattattaaatatgaactatgaaaatttctacccttctggtttttctgtgggatataatcctctggtcttaaaaattaattttagtaatggattttcacaagttcccttggagagcatgcttggaacatttttgtgacatacactcttgaggttttccttctaaatttcttttcatcactcattttgactttcagatttcttaaatatttgttattacgtgtatctttgtaaataaaagtgaggcttaagaagtttgactttgttttaggatggaaccttgttaaaagtacaagcacacatgtgttgacagcagctagaggaagcgtgatagtgtggaaagaaacagaagtccaaagacctaggggtacatcaagttccattatttaattgtcatctttgtctttgctactgaaagtatggtccacagaccatttgcatcagcattgccagggagctggttagaagggagaatctcaggccccttctagacttactggatcagagcccgcattttggcaacattaccaggaactcatatacacactcaaatttgccaggctctgaactctataatctccagcattctgatttctccaagtccctcctttctcatctttgaaacagagtaatttctacctcacaagtctagtcgagaattaaatacaaacatgtaaagctgctgtgttcggtgcctggcatacatggctgtcccccattcctgccaacacacaccttcaagcaagacaacttgagagaggctgagtgggagagagggtgaataaatgttaataactcacattagagttggcattttttttctttttacttgtctctattatatagggtgactgtattaattgtgcaatacctttgcttttaaataatactactgggataaaagtgagattctaatctcacatattatttcaagataaggttcagatacagagttttaaagaaccacctataaaaatcaaatccacataaattcagaggaaaatatcctcaatgcttatataatattggatgtttagggtgataccctctaagcacaacttcaaaggaagaaatcattagggaaaatactgacatatttgagtacatatatgttttaaaatttaatttacttgaaaaggaatgaagataattaaaaaggaagtcacaaattgaaaaaaattatatgcatagacaaagagttgataaatttaacatagaaacaggttttacaagacaataaaaggataaatgtaatgattttcaatagatataagacattaataggtgggcatgtaaaaaatgtcaagataacatgaaaaaattagttttactactcataaaagacatgcaagtgaaaacaaccaagatgccatctccagtctatcagatttctctaaaaatgagaaagcgctcataaccagtgaaggagaaaaggatctgctttcatcttggttaagatatacattgcaacaatatttatgggaaattctttggctatatctatcactatgaatttatgcatacatttttcacccaataattatacttttgagaagttatcctaaggaattaatctaaaactgaaatgatacatgttcaaaattttcattaaagaaaaccaccaaactgtaccataatgggaactattcataaatatgtaaattatgtccatatgatagaatactaggcacccattaaatcatgttgtaaacaatatttttattgaattttttaattgaaaccaaaaaagagcaagataaactcagtatacatagcatgtcatttttgcaaatgtgtatgcaaatgtgtaacatgtatatttttaagattggaagctggtacactaaaagtgaatgttaattctgggttatgtttttcccaaatttttgcctgtttctgccctgcctctttgattttaacattgagcatacatttatagtttaaagactgttaaaagtggcacttagatatagcttaaaaataattttaatagcacagggaaattattttattaatgctagttaaattagacgaaaatataaaattttaatggcagaaatatttcaatttataacatatgcataggaaactgaaaagagtagttagctctaaatatggggattatggataaattttatattcttcacttttttatttcaaaatttttataattagctttaggatttttataaccagaacaaattacatttaagactcccttctaaacttatttgcttattttcaatctcaaattgtgaatttgtatggcctctatatttccaatctaattttacagacattaaatttctcttgaaattcagtgaaaaattagcagagtcgaagttacacttctgtatggcatttaaattcctcctcccagaatacagccactgttctacagtacagaggagtccttcatatcacgattttcattgtgtctaagaggcatgtgtttccactttgtcattatttggtctaaaaggatttttcttctattttgctgctgtttttgtacaagacatataaagaaaggtgttaagggagtgttaaatataatcaaggtgttaaggagaagagcccagagagagaactcttaatcttttcatctggtccagttgtcaaagtcttttgtctttagccatcacttttttaatcagagacatataatctattaactatgggaacaagaaccacagatttagcctgtgcttatctggaaacctcccctaaaatactactgaacgactctttttttttttattcctgtctctttttctgttgcaaactgattgtccactataacctggagaggggactcaatttttagaaactgtcttatacacctcttaattagttacctattgctgcatatacccaaaatttagcagcttaaaacaataatgaaattttattatgcccacagtttctttaggtctgtagtaatttaagagaaacttagctgggtgattatagctgactctctcatgatattacagtcatatacatcaggactgcattcttctgaatacttgactagagctggaagattcacttccaagatggctccctcacatggctggcacattagtgcctgctgttggggggagacttcaattctttgttgggtggtcttctccatggggcagcttaaggatcttcatggtttgtgggctgtttcacaaagtgtgcgtgatccataggagattaaggtggaagctgcaatgtcttttatgatagagcctcaaaagtcacacaatgtcattcccaacgtatcctttttttcacataggtcagccctacgcaatgtgagagtgaggaagggactacagaaaagaatgaattcccagagatgagtaggatcatattgggtgccatcttggaggctggctaccagtgaagaagactgctttctggccctcagtgatttacttccatctcacatgcaaaacatactccctttattgtggttcccaagagtctcattctattatggcatcagctcgaagtccaagatcttatcatctaagccaggtgtactagttttctttgctgtctaacaaataatttaaaaaatgtagcagcttaagataacacccatttacatgtcacacctctgtaggtcagaagtgtgggcaaagggtagctgggttcttagctcgaggttgaaaccaaggtgttagccatggctgcggtccttatgtggagctgagggttctctttcaagctcatccaggttgttggcagaattcagtcacttgtgactgacagactggtgttcctagagaccacctgccattctgtactgcgtaaccctcttcacaatatggcagtttactccttcaaggccaacagaagaatcttcctactgcttgggttctctgacttcatttgaccctgacctctaaacccagatttaaaggttttatatgattatatctggcccaccagcaaaatagtcctttttattaactcaaagccagctgtttagtaaccttaattatatctgaaaaaaacagaatcaaaggagtggtatctcgtagtattcacagattctatccacacttcagaagtggaaattacacaaggcctgaacatgaggagatgggaatcttagaatctgtctaacataccaggtctatgtgcaaataagatcaatctctgttagtttactcttatggggtaattaattaccccaaaacttagtggcttaaaacaatagcataactaacttctcagtttctatgggtcaagaattcagaagcatctttcttcagtggttatggctttggcactcatatgaagttgcagttaagaagtcagtcagggtgatagaaatataaaggcttgactggggctggaggatgtgcttctaaggtgatttactcacatgatcaagttggtattggctgttgcaggcaggtctcatttcttccgcaaatgaaatgctctccaggctgcatgagtgtcttcataacatggttgctgatttacattggatggagagatcaaagaggatgagaggaaagcagcaatgtgttataggacccaacttcaaaagttacacatcattgcttctgccctattctgttgggcaatcctgatgcaatataggaggcaccatgaatagcaggaggcaaatatcatctgggctttcttgttaacctcagttaacaacaacaaaacaaatatttaaaaaactaaaggaaagagatttctggaatatttccattctctgtcatgcccactgccatagtctactcaagttctcatctcctattggacctctgcggtagctttataagtcctgtccttgtttccaatgtcatccctttcaaaacgcttcaaatagcctccttaaagccatgactcctcccacggttataaccctgcaggtaaaggcacttgaggacataatctgtaccatctctggcgtcatccctttcattccccttcacctcccccaactatttttgtatttcagtcatgctggacctcttaatgtttccccaaaacatcctaagcaatttcacgtctctatgccttttcttttcctgttctctttgcctgaaataagaacgacagataatagtgactatgcaagtcctaaaatcgaggcagccacagtgctaaatcacacattggatagttcaattttattcttataacaaccctttgtggtaaatcttattaccatgctcattttacaaatgggcactcctaacccgatgtgcataatgattaaaaacatagactcaagaaaagtttggaggttctggcgtaaccctctttgttattctctatgcaactagcttaaaaataacaactttgattattctaatctattaaccagttttcagtgtgtctgaccaaatcagttgaattttatttttttaaatatgtgtgtgtgtgcatgtgtcagtatgtacgtgttaaagagtagagggaggaagttgaaaatctgacatttgatttatttctcctgggacaaaggaagtttggatatgtcaaactgctggctaatcaacacgttaatcaatgcaaatctctagtatggatatagttatattttgcccccctcttcctttccaaacttctttccagtctcatgaccagcttattggcttcatattaccaagtaaatatatcaactgcccatatgtatagtacccagacaatgagaacactgcctaaatattgtgttttcaatactacttgcttttagcaacaaatcatagcacccagcctaactttaaaaattccatgtcatccaacttcaaactataacaaaaattgagttttacagaagagtttcaaaacatttttatgcattagacacttcagaaattatctcttaaaaacaaaacaaaataaataagggacaaaaacaatagaaaacgtcaggcaccaaactgtgaactctcttttgtccatgtatgatttaaaaaaaaaaaactcactgatggtaatttaagaaatttgacctttaggaaaatcaggctgaggctcatctttgtactttttaaaacaagtcaataaaacatataaataatagagatgagtgcagctcacaggggacactcatattttctaggagcctgtggatataaacaatgaatttcatgaacacagagcacatttctacatgatctccttttctttacaagttatttatgttttactggaaatattaaaacttcatgtctctttgttgctcttgtttctttaaatttttatttttatcatcagtcattgttcaataactcaaaatcatataaaataaaacagtttcaacatcattccgtactcaagatgatctctattaaataatgatttttttcttgaaaaagcattctataattttttttagttttccagatgactatttaaaccaaatgtttaaatgaatgattaatgagtcttttatcttatttatcccacctgcctactgcaaaaagacatgaatttaatacattttagattttaaacagttgtatatctgtaaaaaaacaatttttacaggtttcatattctggacactagaaaacacttcctcctcacagcgccgagttgtatgaaaaggcagctcaattgtctttccttgagcagccttgtgtgcctgggtattcccttccatctctcacccatggagttcatattcctgttgtcatgtcaccacctcagtcaacgaaataggttctgccatttctcaaattttatggagaattatcctgatgagttaaggcagaggttgaaaacttgcagcccttaccccggttacggattttatttttaaaacccagtgtttttgaacactttacagctgatatttctattctaatggatgcattatcttcttttaaaaatacttcctatattagccctcttaaggggtatgaagtggtgtctcattgtagttttgatgtgctttactcactcttaataccgttattataggttatttattgttaaaactgtgatatattttcctttattttctacatatacatagatacatgcagtttgataatctgcatttaatcgcattagaaaggtattttgctatgtcattaaaatttttttgtgaacatcatttttagtggctgcaaaaacttacataaagacagacatgtcctaatatatgtgtgtgtatattttaactaaatattggcacaccaaaaataatggatttaatgcaactagcaatgataatgctcaaacaacaggagtgctatgaagacaatgaaacaggtgagttgtcagaacaccttctgtcattacattaacttttttaagcactaaattcacttgaaattacaataaacaagataagtacaagcattagataatttgacctatcagatatcccaaaggcataaactatcactagagggtcttttctttatgcaattaggtgaccagtgactcttattttttaaagcttttaaaataaaaaaatagctttagggataaaaccagccagatttttatcgtcaaaaacatgttcacagttcagctaagccttgctttcttttgaagaattgctctttataatgctcaccaatggatttagaaatatcccattgtaatcatgaagatctcaattatatgttatgaaataagaaacataatgaaatacttgaaccttcctgccccgcatagcagatatatttttgtatttatgatattcacagtaaaaaagctgtgctgagaagctcaaaatagtatttgatcttagtggttttggagcagaggaattggcattgccatgatttttctataacttggcgcaggccaatggtttcaggcaggactttcagagcagacttctgtcaaatttgccatatggagttactgggctcagattatagaggttttcctggttgtttgcctaatttgggaattatcagtgctctccaggattttctccaaaaacaaagaacatgttcagaagaaactgacacttcaggaagaaaagtagtttgatatttgagaggtttagatggtttctaatatttctaaaaggtaccatgactcgtgaagaatttgactggtaaaaaagaaaggttcctgttatccctggaacacagctaacagtctggcatgtagccttacctgaactggtaccctccccgtacacctcacacttagcattctgcacagccaaagaccctgtcagttattggccagcctgaagaatgaggttgaattcaactcagggactgaaatctactttatagcattttaaaatattgtagatccaaccttgagttgacctactccgcaggttcatgggtgattaggtgtgagatacaatgggaatgaatatctgaaaaccctttgcagaagagaaggaggaggaggaagaataaatccaatttttacaggtttcatattctggacactagaaaacacttcctcctcacagcgccgagttgtatgaaaaggcagctcaattgtctttccttgagcagccttgtgtgcctgggtattcccttccatctctcacccatggagttcatattcctgttctcatgtcaccacctctgtcaacgaaataggctctgccatttctcaaattttatggagaattatcctgatgagttaaggcagaggttgaaaactcgcagcccttgctccaattacagattttatttttaaaacccagtgttttttaaaaaatcgagggagtttacacaaaaattcatgttttctgtttctctagaaaacagcaaatctggcaacaccctgctcacattcccacctaccaagaatgctgcacattaaatggtggcttttctttaggtgactctaattcactggggtctccatgtgacgtttcagcctttgcaccctacttgtccgctgcaggcccaggagctctctactcctcatatgcattacaggaccccatgcacattgaagatgttttctcaggcagagcagacaccaggcaaatatcttctggtcttaggagcaagtcttctgagaatcaatgatgacaaatatcttaaatggtctactcgatggttctgaaaatgtaagagctaaactacctgtatcaaaatcatcttgggggcttatttaaaacatatatgataaggccccacctcaaacctaaggagtcagaatttctacggaaaggcttgggaataggaacattaacacaagcatcccgggtggtttttatgaaacaaagcttgagaattattgaattcttctccgatctgacagctcttctcctgggcagacccaattagagggaactgatgagttttaggaaatactgtaattctaactcatcagtccagcagtgctgaaaatgcagaattttgtccttatcaaaagccaattaatgctaaccttttcagtgtgtgtccagtaccaccatcggtaaggtaaataaacaggcagttttgcatataatctagtgatttttaatttagttttttcccttactcatcctaaaaaaagcagggagtcattgggcttttgtatctattttagctgagttattattttaacccctatctttagtgcagaattaaaatatcacccttctatttgcttttattcctaatatctgaatggtttcagcttgacgcaattagcatgtagagcatgctcacctactgtaatctcccagatgagtcactcagctccagcacataactgcttctgggatcctgttggctaaccaggctttgaaacccagggaaaagaactgtgtgttttcttcagaagtaatccataaatgagaaattaccataaataggcagttttattcactctaagtgatttttacataaaaactgacaaggccgtaaattgtatatagaatcaggttccatatccacacagctaatgcacacatgaattattcgatgaaatttgcttcagtagtattatctgaaattggtttcagacaatacattaaatgttacacattatggtaaatttactgtatttttgttccagccacgtcttgtgttggcaaatctgctaaatttaagtttgcattgtattcacatgtgttgctatttcctgagatgtcccaatatattttagccatcaaacaaatagaacttcacctctctgaggctcagtatccacacttgtttatcatgcaagagacatgcaggtgagaaaataggcaactgccattctatctgtgattgctgttcatggaagaagtaaaaatgagctgggacaatatataggtggcgccagggatggctccttgaaggaagtgatctcacagctcagacctgaaagctgagtggaagttaccagaggaaaagagaaagggaatgcattggttttctattgctgggtcagaaactaccactaactcagtggcttaaagcaccattcattatctcatgttttccctgggtcaggagtcaggtgcgtatcagagtctcaagaggctgacatcaggtgtttgcagatggcattcatgtctggggctcagggtcctctttcaagctccttcaagttgttggcagaatttagttgctgtggttttaggaccgaagttcccactttcttgctgatcaccagcctggggcagctctcagccccttgaggccacctgcagttcctcatcctttggcagatcctctcacaacgtggccacttacttcaagaccagcaagagaatgttcctcttcaggaagggcccaactcctccttatggatgttcttctgattcagtcaggcccacccaaaataattgccatttttggttaactcaaaaatcaactgatttgagatccttaattacatcagcaaaatccctccaccttctccatacataataacctaatcatgggagtgactgttcatcctgttcgtgattaggctcacatataagagaaggagatcatataggacatgcatgtagaggatagaatcttgggggccatcttaaaattgtgcctaccacaaggaaggattttccaggcaggaagaaccagatatatgaaggaggcctaaatgacaggatagcaatttccagtgtctgaggctaaggctggaatgctgacctggccagatcatgcactgctaggtttaatggcctatgcatactctattatgcaattattaaaatacctgtttacaaagaatatttgaaatattaaaaaatggaaaactgcataccgtaaaatattaaatgggaaaatcaggatatgtgtttatataacatagtatcagttttggaaatatatatgcatatcttaaaagactagaagtaaatacatccatctgttagccatggatatctctgggtgagaaagtatggatgagttagagattctttgtcccttttcttagttctaaaatttgccacaataaatatgtattctcttataataataattaattaaaaaactattcatggtacttgcaaaaacaaatgaatttgagcagtctctttgaaggaatcaaattttgtactccaggtgtttgagaggttgaaaaacaagctcaggaattagctgcgcatgatctgtacaaacaaggggatcagtcagtggaaatgaagtccagcttcagccaagggtggtgagtataacagacctactctgatatgtttcatcactaaacattgagcaagaaatctagtgtttaaattatggaggcattaaagcaattaacctccctctacctcaattttcttatatctaaaaattgaggggagcaaaattccattcttgtcacaggtctcaattgcaagtagcatgcaagcaagtaggctgaactcttgtctgtcaatctagctccttcctggatggggtatttaatcagctctccttcccaagcacccagtggacttgaagctcacagttagacagagatggctagaggtgccaagtgctgtttatcataggtgacatcacctgtgtgctcagagttataaacataggcagcttgcctactgccaaatccattacaactttcagaggtgttcacttaggaagaggaggaaagagttttttgagaaccagatgggaacttagaaataagtaacattgacaaccaaatccttcagacacatcttcaagtttcaagagagcagttaacaaaaaagaaaaatgtatttttagaaattgtttgggaggtgaaaggatttttctgggggggagtagggtagggaatggatagagatgatttttttttggctctgcaatatctcagagatctttgagttgaaatataacaaaatgtatttcctctctcttgctccaaaaactgaaaagcaagtgcactagaaaatgtcagagttggccactgaacagaccatatttctaattcatggcaagatggctaaaataaaaattcttgaaatacgtattttaaaattagattttgacctttgatagggcttatcatgctatttatattgtagcagaaggaactgattttttagtagttgcctcatcaaagacatgactcacatttccttaagcatttacaccatatgtttcctgaggtaaaaaaataaataaataaattttatattttttatacaattagtgaaatgtgagcaaaaaatataagaaatcatttaaaaaatattttggggaggatgtggtctagaaatgttgttttctagaaattgaaattatgttagctatttggccagtgtagccattaggtacatttatgaatatagatgagaagtaatcattgtgatgctagttttatcattaaggaaaaaagcagaattcaaaagtttagcaatgaaacacaggtactactgaaactcactttatatttgaaaatgtgaatgtgagtttaaaaaagcttttgttagactaactgaaaagaatcattttaacatttaaaaagaaaaatattattttaagtgacatttggtgacattattatatgtgtacaagctgtgactataagataatgagacaaattattatgtggccagtggaaattaaatttatctttatgattactagcaacagggactattttattcaactatctttacataatacaaaattattgtaaaatttctaggaaattcatattccacttaaaatatgaggaagtacatttggaaaaaatattaacatatgaaaatcagcatcccagttaaggaatccccagtttcccacttggtgctcaaatcacttcacgttttatttcattggtactttttctagggcagtagatttaggaatagaaaacagactctacacatggaatacactaaagtcttgaggaggtgtgatatttccctaagtttggataggtggtatcatcctttcagtcactcttgactctgcattagactctctacctaatgatccccaagtcatttcacttctgccttcttaacattttgaagatgtcctctaaaatttcaagtcccaccatctctgcctccgaactcacctccctgactttcagtcttgaagcaccttaacaacccctcccctcctgtgcatgttccacctggaaaccagggtgatcactctgaaatgccaatctgatcagtcatttccctacttttgaaccttcaataacttcctagcacctattcctagaaaccattccaacatatcacctaggcaaaggaaacccttttcttacctggctcctacttatccctccagattcaccttttgacacctcccacttcatctctctgcagcccccttcctgcacacacacggagtttcagtcttgccaaactcttcgcagcttcttgagtggaccttgctctctgcactacaatctctttctgcctagagagtcctttacctcccccaatctggttaacttctactgtttatttaagtcttaactctaagtagatgtcatttttgaggatgctctctctgttcccactttggaacttgggcttctctgttgtcctggtgtcccgtgtattcctctgtcatagccctcatctcattgaattgtaatcatgtcttcactagtgtttcctttctagcatgatagatttttgtattgccagtgaccccaacaaattccccaggtcctagccctgtgactggaacacagtaggcatttaataatagttgacaaatgagttagtatatgtaatgaaaaatctacctgcctgagcattaggaaatataaaattaatctaaactttgccactttctgtaatatctgtgtgtcagtcaggaatgcttttggctgcaagaaaaccccactgacagtcttttaaaacaaataaggaagtctaaaaggagtcagatgctggccttggttcaatacaatgttagaggcagcatctcagtgcttctctaatggtcacaaaatgactacagtaactccttccctcacatccacttccagttcaagaagcagaatgagagacagcaatagccaccctgtttcttcatcaagaaagcaaagatatcttagaagtccccactgtccttcatttacttctcatgggctagaattatctcagtggccaccccaagtgcaagagaaactagggaaattagtttttagcattcccacactctatgttgaaaatgagtaagagacaataatttggggaataggtgtgggattagtcagccaacagtgtttgctacaccttgggacaaaacattttacctctcttactctttgattctttcattgagtgaagaattagaataagtaatctttcttcaagaatcaattttctctcatctataactcccatatattcttatttccaaaatggaattaccttctacaccagacagttacttcaagcttttcccctgaatatttcacatttccagaaagcactatattacaaagaagcccttccttttcaagaactctatttgccataatgttctccctaacaagggctgaacagtacgtgcccagattccctgcctctgacctcaccacaccctcttctgtgtggcggtctctcaaattgtttaggacaattatcatgacttctctaaatctccctttttccaggctcaaattccctatgcttcagtagtttttcagataagccccttctgtcccttcacaaccctggtcagccaacaccagacatactctcttcatttacttatgattcattgaacagataatcactgagttcctgccatgtgtcagcactgctctaggagctggtgatatggtgagaaacaaggaagggaaggcccctcctctcatgaggcttacagaggagcaaaggaatcagatgataagataagcgttacacacacacacacacacagaggatcatttcagagagtgattcgtgccaagatgaaaatgacaaagggagataggagagtgacaagggatgtgtgtgtgtgtgtgtgtgtgtgtgtgtgtggcagtgcacgtgtgaaactagaagacaagccttcagatgatcagggaggtttctctaagacctgaatggggataattaactagcatggaagaggaagaggttttgaagcaggaggactttgtaagtgaaaggccctgggtagaatgagctagacctgagccaggaaaaaaaagatgctcagagggggaaagtgttggaagatggcctgataatgcacatggggagccccccaccacaagctcatgtaggacaggacaagaactcagattgtattctaaatgacagtatttcaatacccatcttaaaatgtgtctggacaaaacttaacacttagctacacatatagcctgactggagcagtccagtttataacctctccttgtagtgggcactgtatttctatggatgcaagctacagttatatgacttttgtggaagccatgctatccccacagttccactgtgatttcctatatgctctttgatgcacactgctcacatgcatgaatattacttgcacaaagagagagagtaggtggatgtgatgccaggagctattagaatgattcacattacacttccaccatatgaaaaataatgtacagtctaaagcaacactgcatcatatcatcgagcagcttgggaaagcctaaattacatatttgaagttcagtcagtcattgaaattagataatctggatggtcctgaaagtgtctttcttgagagctttcctccaaaagcaaaattgaatggtaaggaaaaaaatgaagtacaacaaaaatgacagcaaaaaacctgaaaaacaaaaaacaaaaaacaaacaaacaaaaaaccccaaaaactgagtaatatcaaccaggcaggagttgaaggagagaagcccaactgttggtagataacttgggatgagccaattaaatattggtcttctctctctcagaggccctaattgcattccctccagcagccacaggcctggggttttccccaggcctgtggcattcagacatcagagctgagaactccagtgaccaccaggctgcattttaatgctaagctgggagcactgatactctccaagacagccttgcaagctccatcttccactgactcaacgttcagtggaacgttcagtgtgtttcatctgctgttcagtcatgcaggcagcagggatcctgagggctctcctccccaatatggtaccaagttttgattcatccttttcctcttccctatcagcaggtattctagaagacagttttatgatgacattcacagctagcattaaaaccagataaaaataaaacaggatgtcaataaagaactaatgatgtgtgtctgtgtaaatgtataataataataaaaagaatagacatctgtttgtcaaggtaccatttaaggccttggggctttaaatgaaactgctttataaatgcaccaacatatgtgactgtttgcctacgtctttcatccatgaaaattgccctgtagacagttgcctttgaggtgaaaagcattctataggcactaaatattatgctagaacacctctaagtgctaatctaactaccttcatgacggaagtttcaggagaacaatttaagggtcatggaaaaaaagtgttaaacgagttggtaatctgacatttcctaaaaactagattcaaaaccgaagggaaagtagagagaggaatcaaaactagcctagtaggatggaagtaggcctccctccttggaggtgtgaaaatgcctggaataatttaggcaagaatgccaactgtcagtgatgaccttggtttaggggcagttatagcatggtggaaacacccctggactggagatccggcatcccttatggggatatgaaagaaatttggcaggtctcttaacctctttgacattcctttcttctttgttaggtaagaagctggtgctggttcagtgtaatttgaactgtgttctgcatgactgtagggttctgcttagtgccacgtggaggtggggatgccttgggtgaagatgaaggaggtgtagtaagcaggtggggctctgcactctttttactctccttcttccagtatcatcagaacaactccacttttttgtctttatacactgagttatttataaaatcctagtttttttaagtgtcaaacaatgcttgattatgaaatgatagcattattctagcattctaactaaagtgtgtaaattataaacaactatctttaatggtcaacaaattgtcatcattactgagcagtgttgttagtaacaccaagtaatacaattaatgaaatccttgaaagtagaacctatcagtgagccatgcatacaactgataagctgtggataatgtatagaagaatgagttcatttggtaattatttgtacttttcaaaatattggtgaactttcatctttaaggagcaatggtgtcctagttattcttgccacaactgcatggaaactctcgaatctgttagtatgtccttgggcacaaaaacagtattttttggaactgctcaaaaattatgtagttttgtagacatttagggaaaaatctcataatttatgttaaacactcagttgtcttggtgttgattgaaagcaaataatacgtgcttaacatcctgctagttgctgagggagattcattcatcattttagaaaatgtttctgggcatcagtcatataataaacactttcccagcacttggcttcacaaaggaacaaaacagacaatgcacattcctgccctagtggagcatatattctagatgacagactgaacacctagacatatatgacaagctctttcttgcaaggagagtccagttaggaaaatgtcaacacctaaaacagttaaaggctaagatagcttctgtggacactaagtgctacatagtagttccagaggaggcagagagttagacctggctagacactggacagggggtagaattagacagatagttcctggcttggtgcctggtacatagtagttgctcaataaatatgtgttgaataaatgaaaaaccaggactgactgaatagacagtttacacatttacataataagtgtgtaatttagggaagtggggttagaatgagcctgggtgaaggaagccttgaatgagagatggagaactgtaaacgataaaggttttgaagttggggaaaggtgagggggaagtgaagtgtaacatggagaagcaaaagtgtgaatattttccaagatgcctcgacgttatgatagatgaacctctgagacagaatgtagggggaagatagaggaaagagccaaagagcctctgagggtgcaaagaagtaaagaaaaaccaggatgtatgatgagaattttattatggagctatccagtgtggatgtgacttctcttccccatatcgacacaaaacacttagcaaaacatttctctttctctctctcatgctctcctgttctttctccctctatctctatctccttttgctctatctctagatatctattagacagatgatagatagacagatacatagatagataggtagatagatagataggtagatagatgatagatagatagatagatagatagatagatagatagatacatcttggaagtggtaagacagaaaaagtagtgagtatagcctcaaaatggctgcagggcaaggtaagaagctgagctcagccttcaatccaatccctgtttacactctgcctatttatttgtttataatatactctgactccccatcgacatatttacattcttggtagaagagattatttttgatatctctttgtatttatttcttagcaccaagataattttaaccactattttattattgtaaattctattgtttttactccaaagaaatacatatttgttgaagaaaaattagagatacagataagttaggaaaataataatatcagaaaacagggccatcatttaaaacatggttacataaataataaagtactgtgctaagtattgtaatgatgctgatgcttttgtaataatgatactgatggtgaagatggtgatggtgatgatgatgacaatgatgaacacatacctcccactgattatgtgtaaggcactgttctaaacctttgtctaaattaatgcatgaagtcttcacaacagcctcaatagatgttattcttcctccctcctatttattttattttagcatattttatagatgaggtatctgaaacagagataagcaacctggcctgagtcatacaacacaaagtgatggaggtaggaaatgacccagacggtcaggctccagttttttgggcactaccaaattatattaataatacaactctgtagcagcctgctttcgagttatggaatagtttctagaataagtcacacacatagatttcgagcccaggaccatctactctgagcagaagctcctacctaaccttgactataaactgactctaccagataatcacacttggcctttctgtaagtgataagcaacttgcctctgtgggcacctaccctgagaaaggtagtcaccctgctccatgctctgtttcaagtacatttattattatttatgaattacttattaacataaatttattattatttacgtattatccaacttattaagtgatgtatatgtatgcaggtgtgtatgattatgaaatacaagatgaaagaactgtaagaaaatagctttgaaaaaattagtaatgactgggccatagcccagtgataaggcatgttcacatataccatttcctttcatgatggtaacagcccagcaaggtaactgtcatcagggctgtcatgtattctagtactgtttgtgtactgaataaaggcatttgcctgagggatgatagggctcaaatccaggctgcactcctcttgatgatctatgaacccaagaagatgagtctacctggagggaaaggcttttccaatatgcacaaagttccacagaagctagagttgtcttgggaatgattatctccattttgtaaataaggaaattaaagatcagaaagattgagtaatttctcaagaatatgtatccagcaaataacaaatcaaggactcaaacctaggccaatatggctctcacttcctttctccaaaatcactgctatgtctttcaactaaattgcattgctctgttcactggtacaaagcttgttgcaccatttaaaattcaaggactatctgattgtgtattatatttttagatcctttcctgaaagcaggttttaatggggagggagaaagtagcaactggaagagagttttgagatggtagatggtaaaatgtgcaagcaaattcccaaaaaatctggggacacagacttcactgccttcagaataattgaaaggagaacccttcaagtatgaagcttcagctgaaatttcaacgtggtttatttacctaatatgctgttcattaattacaagctattagtgactattagcctatgaaattgtatttacagttcagaaatgtatttgattttcacaagccttactggggaacaatgctcagtcaacactttcttcgcctaaagagtacgatcaaagagcatgaagcgtagtaaatgtttagcctttgaatttggagtttacaaaggataattatccacgggttggtgaattcatgttcctctctactccacacagcctctggtttgcatttacagttttgcacaatcagatgtaaaattaaaatataatcattccattttaaatggttccctgtacaattatctcattttaaatcttttgctaatgtggttattctaatgcaactatgatcattattttatgtatgtaaagatgtcaatactgtccagctgatgatattatctaatagtatgtagcaaagcatgttcccttcctacagtgcctcactctttcgatgggtaagatgggaggtgggagtggggggagcatggcattagctgtggataataaagcaaagtaagtacaataggtgttcaataaagtcatcatttttggtacttacgatgtagttttcttgttcctttggttccttttgcagtgggtgtatttgcttagacagagagaagtggcagagggagactgcatttgtatttggttatttcagagaaatgcaacttggtattatgagcctttaattctgtagggcagtctccagatcattttgatgctgaactttgtcataaaaaactattgatttttttcttccaattataaacatttgctggtttcttgtcagttaataactgacataacattatttcagacctttcacttagggctctgttgtgtgtttctcttgatcaaaattattgccttagcatatcaactgaatacacaagagaaaaatcaagttatctatgtttatcatatgcatttttgaatacctatatgtgatgcttgagcatagtggtttttataatcctgtaagcgatttttcaggagaccagatctgacctcctctctcacacccctttcacactgcctgcaacacaccacacataccacacacatcaccaccctgaccgaccaatggaatctgagccaactataaatctcaaacttgttgatattggataatgcctggaggagaaacacggctaccgttcagtaattccagaaagaatttcttctttaaactcagtaaacccaatggcttctcagaaagttctttctgagttttcttatttgaaatttgaaaattatttgaaattgacttaactgacatcacctgttcccctctggatctcccagtgatttactgttgactctttcaaatccactcatctcagggctgggggactgagtcacagtctgctttttcctccattgtcatttccaaatttttcttccctctccttgctgggggctggtgctaagttgaccccatttttccctccttgtgctgtcactcactgcctttccagaatcttctgcatcaggtcagtcactctttccaacttaattccatatgtcaacccattcatcaccggagccacgtggtttccttcacacaaattgtcttctctgcaccacagatgccagtacactctggcccttgccatctgtccttaagatgcaacaccggtctgcttccaaaatccctagttcagacagcctgccttccagttgccacatcctgtttgtttcccagtttaactatgtcactgccactgctgcttctacttgtcagaccttcactgacctctccatttcccccatccctccatttcatccttacgttccttccggcccccatctctgcttcaacgaatgaacccgttttcatctgtttttccatgttgggattctagtcagatttccttgaaattaaagctttttctagtataaacactcagcctgtctctctcactttaaaagtgaagacatagacacacagagaagtgagatgatctttgtccaatattgattagtggtggaagtcccttgatagccaatccatatttctttcacagtaatagaaagtaccaaactttaaaaatgagattagaagttgcctttacataaatgtttaggcttttgagatctcagggctattttgtaatactctaattttaggaatcattgttacaatgtttcaaatctactgacttacacatatatatcctacatatattgtctaaacatattctgtagaagcaatggggattcatgattatgaaaaaagtggccattgctggtttaggcagtgtgtaaatgttgctactgacatcctaatgtgattttaattcttgcagtctggtgtcataaaatagctttcaaaaaagagcattttgatcacgactcattttccaatttctctcctccatgatcccaacatcttcctaagaaatccactctgtacctgagtttccacatggaacttaggacaatgatgttagtgaattagaggtctggcagaatcaaacgaaagtaatcctcaccaagtcactaaaccacactactttgagtctatgcaagttcaggaatttctatttgagcaaaagccacaaatggccagagcggacctcaggctttgtgcttgaactgcctaatgccatttgatttttcgatcccgcacttttccttgccagaccaatggtcttttctagcagtaaaatttcagaataggtaggctaccatcactctttgggttaccccagtgtttacttaagttgaaattcaaatagatatgtatttctatatgaatggctgccattctgctatgcccatgtttctgtttctcactcatctctggcttgtctcgtagagccctttctggtgctgacttatgttgctgagtcaaaggctttcatagtcaaagctcttctttttatctgatatgttttgcagtttgctgtactgcgtcaactctactgggatcatatttctcttgagactaactactaggcaacctgtgccttcttcctgcactgcattttgcaagtgcttcttaggatttcactttcatttaaaggcagtagatagctcagagaatgtggaacagtaactagaacagatccaagagctgtagaatcaaagaagagttaactactgtctctgaaacttagaatgtaaccaaagtcaagctatgcaacctcactaagcctgttttcccatatttaaaagtggattgtaatgtttatgagtctaccactacatcagattggtgcagtgattacaggagacagcgcatgtaaaactcctggcatggagcctgatgcatttgaaacatttactacaaactaccattgttgttatcattattaaaaataacccattctttcaaagaatcttgttcttggccaccaagcttggaagtcagtgatattgttcatcttatttgcccggtttttttttttttttttttttgagaataatttatgacctctgtggcagcaagtctggcctcatcttgaccattctatctgcatgtactaacttttcaattttaatggccctgtgagctttcctcccataagccaaaaagtgctgtttttctattctagtgttttcttgtcaggcaacaataatttctaaataacatgcctcttctaaaccaatctcttaaaaaatagattgtttttgtttctgaccctttctcattccatttcagaaactattttttctccttctttaagcaggttacaaacccttatatttttaatatgctgaggcttgtagtcaaaccattactgtcccaaaagaaaagcccttttagcacatttacagcttcttgctatctgtgccctaactaaattgtgctacagggatagtttcttaaccattaaaatgataggtgaacacaattttattttgaaggattactaagctatttttaaaatttctatagttagaaaagaaaaactgtttaactgaaacttgaacccaattaaaataacaattctcatggctctccgttttgcaatactttcctattcataaaataagaatgtgcactttacctttttgacccatatatttgatgtttttcaattctctacacgttctttatctctctgtcagtgtggaatattctgatttgttaattaatacccaaagcagcagttggctattaatgaaatgtacagaaaggtatttggtaaaggctacatgaagatgatgatgacaataacaaagatatctgattgaaagtaatctttacctgttaatcttcccttaatgtctccgactacaatggcagacgttgctttcttggatgatgactgaaagattagtttggaatgaataaatttatttttccatggttgattcatagatttttttagaaattactaattttgaaaattaaaccttctttttcagccttttgagttttatgtttctatagtttaggcttaaaaataatgtagacattagaaaaaaactcaagcggtattaatccttatatccctaatggtaaagagcgaggcagctaacaaatgaggtgctggaacactagcaagggagcctgtctctcttctggtccttttgttgtccaattacaggtgaaaagatgctatctgtcagcttgtcattaactcaaatacacaaaggcctgtcagttctcttatgcacttgccaatgtgagcacatcccatattgatgtttctactaaggcttgctgtacttgtaaacagtgtacttgtctggtaactaaatagggacaagcatgcagtaacagtgtgacactgagcatttcagttatatgtcttcttacctcagaattttaagaagaaacaatgctaaaggagattttttttaaaattaaaaacaaaaactacctttccagggtattttaaagaaagaaggtgaattccaattgcacatacatccggtatgtgtgacgccaggtttatccatggcctctctcgccctactgctttttaagtaatatgggaaatgcaaataacaaataaaaacctacttaaatagactagtaaaaaattgagcaataagggatcattgtataattagattagaatagtgattttgcaaagggttttaaaatgccttaacataggcactgacaaaatgtttgtaggtcttactaatgaatttttatgttttttcaatggaatgtgcattagaatgaggccattagttctttgtggttaaccaaaatctcaagatttcttgtaatgagagtaacttttctttctgggatccctgacaaaccggaagagagtgctgctgaaatgtgggaaaaacagctgtgttataacaggagctgccagccccccacacagctggctgcagagataattaattgtgaagagagtaaggaagtaattcacataattgtgtaaatgttaagtaatttacataattgggtatatatacaaatggatttcttccctaagctatttttttaaatacagaaaaatctaatctacaagcagttgattattaaggaaccaatttttaaataaaccaaaaaaagtatctattctaatgtgtgctatttttcacaaaaaaagtgttttcctgtgactgtatcctgcatcccttgttacaagtgtgtgtgcatgtgtttgtgtgtgtgtgtgtgtgtagataagtatatgatgtctttctgggactatatgcttaatctcactacaattacttttgggttattccatcagcaacacaagtaaatctctctagatactatttatctcaggagtgacaaatatgtgttaagaatgacttctattacccctgcattataagtttattttttccagtatttttttccctttgatttgagacttagcctaggcatcattcccaaagaagtgctccagacagccgccatgaatgaatcagaactggcccttggaaggaggcctacctgccggtcctctaatggacataacttacttttacctcacagtgttactcagtgctttatctactagggctcatgagatgcagtgttcatactgttttgtttccagaatccctgggtgtgttttattccctcagttgtatataacaggacgcacaatggggtcaggccaatattttttggctcttaaaaggactcttgctgaggtttgccagtacctgctgatctgcagctcccccagcttcataagcagtgataggagtactgagtcagccccaaattaaagaaccatgcatagaacaatgccctgcagcagactcgtaggacaaatctgaaagagcatccccagactcttgaggcatagatacctcctgaaaataagggtctgccttctataggtcattactttggaacatttaataaagcattaccaaaaagaaaaaatacatgtattttataccctcacatttctttttagtcatctttagttttgcttacagtctgattaccccctcactcccaaatccttagctccttacaaaaaggaaaaaaatattttctataacatatatctggaagttttaattttagatttatagtttcacattttcaagccagtatttttctagttccattttgctctatttctagatcattttttctctctcttttctcttaggttttgaaattgctttagatctttaaaaagccattcaccagatttttttttaacttggcctcaaatcatttttactaagtattttatttgagccatcttttttcttttttccatttgttttgttacttttctctccaccgaccctctgctatcaggcaagcatttatattttctattaagtatatagtttctcctaatctctataaacaattatgtgaaaataataagttaacaaatacaatatgacctcaattaactgtcttaatacaagtggaaatggcagagataattccaagagccaattttttattttaatgtgtttttcatatgtacattttaatgggagcttttatgatattatttttcagccacactatttcaaagaaaacaatggagggcattttgtggagatcaaattctggttgagctgtttggacacccagctgcccatcctttctctaatgctcctcccgagcacccagcatcatctctcagaattagacctgaactagccctgacctgaactgattcttctgtccctggtcttctctttctaaattatattttcttgatgagtattttctgtttctaaattagcatcctccttctgggcagtaaaattgagtgagtattagacaaaattgtgaaacgtgtaaacagacattgaatggtttaattaatcagcaagatgtgcagttgaacttgaaagtaaagcatgtgcataataatcctgaagatgattgaagattaattttagtatctgtgatcagataaagacacatttcaatgatgcaacaatgtttaacacttgcaggctactgcaacagaatacttctttagggtcctgaaatcattcttgctttccacaaacttagttgagtgcattaagagattctggctcatagactacttctgcttgttgactcatgccttatccttttcacaggatcactatctagctttaattaattaagtcaggctaatatttaaccagtcttaactactattgctcaccttgcttttctatctcgtgttcattgggcctgtcttagcaaaaaatgactatagaggcaatcaaaattttttatctgatcataagttcaaagttcaagtcagataatttaccttaaatctggattgaaaattaatcatatccccaaagttttggcttgagtaacagtctagatgtttttgtgtatttccttagattcaattctatcaatcctctcctgtgacacctgtaacattcctatagacgattcctgttcaatggtaactcttcacagtgtgtcaggaagagctcttagagatactattagtcagattattcaaataatttctttattgtatattcctatttggcaccaatttgatagtagcatttccttgtgtggatagtttccctttatctattaaaaaagcagtcttttctgactattttctattttcccagcctctactcccttgcttggaattgactgctgtgttaagagctatacaggtttacagaaactgatctttatgattcccaaaacacttggcttttgtgtgaaattgcaaaaattgaaatagcctctttggtacttggtacttattcaaaatgttctcatgtgtcttttggctgcattgcatgttgtgcacaggtaccctagaacttaaagtataataaaaaaaaaaagttctcgattttccaacactgatgatagttccgactttgcagattagcaagaacatgaataagattaattttgcataaatgtttttcatgtgcacaacttggagatcttcagaagaaagaagcaacgcgaatctcatacatataatctttccgtagcttctactgtaaattttggtgaagtgaaacaataaaatttgtataatgtagaaattaagggctgatgactgaatggtcattcactttaaattcatgtatttattgaaattattactcgagttcttggctagggatatagaggtgaacaaggcccaaacttgaaggagtgagtattgcactggagagagaatcatgcttacaaaatattagcaggcccatgttccttagtctctgaatttgtaacagaaaaacacaaattctttccaccctgagtcactcctatccatgaggaattgattgatttaactggcaagtggcaagaatttgacatcccttggttcaagccttccagtggggtaaaggtgtgcttagaagccatgagcacaggggatcttgttctctcatttcttattcccatcaccagctttccccagtagactggatgggtgagaaggaaggctcaattaattgcagaacaattgagtaagtgtcctccatgagcagtttcctcccagctgctgattctcaggaccaagatgaggggaataattagaaagcctgatcctggctgcaggtctctgccctgatgcagtggttgttaaagtaccagttaagtacagctcaagttgttcaactcagaaggcacaataagctttagcctaatactacagttctatagctttatggatggatacagggcaacggacacagcaggtgaagcatcttaatgtcatcagatgagacagaacccacccaggtacacagcttccattgcttcctcacagagtgtgtgcggccaccatggacaagaactaaacacctgggggtcactttaccacagagactctgtcctcagtttccaactagtctttcaaaactgttctggtttagatgcccaggtctctatgctaccctgcagctccccacccatgtgcagtgccaccaccaacaaggcagacatggcatgctgtattcttcttaactctgtagcttctaaactatgagtgctatgagaaggcaactctgagatggttcttcagcgtaggcctgggttagctcagacctgatgctaaccctttacttacaatgtccaatccagatttttcaacaataaagatattttttatttttattggatgcttttgtatgcttaacattttatctccaatgtatcacatgtgaaaggctctgtggagtcagttacactcctttctctctggggtaaggacagttgagatacattgattgcacccaattgacacgcagagaccagtagacatcagacttttttcatcttactaatgaggtaaattaattatgtcttcccgtgaagaggtctaaagtgatgctctagtgctattaccaatccaagagtggtatcagaagtctcctttcagaaattgagacaaagaaagaggacacctctattttaagaaaacaggtataatgctgtaatatatcactatccacagtgcagtgggatcccaagtgaaggtgtgtccaagtgtgcctggaggagatctgcttctcattgtagtgagaatttgagctgggatgataaggctctagtgaggtgagcagagagagggcattgcatgtaagggctcagtggatgccagaggggagctgggcaatatccaggagattgtgaagcatacaaaagactgggactttcccgccaaattcatacttacattattaaataagtacttgtcgtcatccaagttaattaattgatttatttagatttttgaaagcctttgaaattgtatataaagatagatactcaatctttacttaagaattccattgtgatctcaaaattctttgaactattctcttactcaacaaatatttattgaatggccactgtgtgtcaggcactagtctttctataaacataagggatgctgcagtgaacaagaccggaaaggtccctgctcacagaagggttacattctagagcttcactagcagtacagtggtacagtaaccaccagcatgtgtcgtgatggagcacttgaaacgtggccagttccagtggacatgtactagaagagcgacgttcacattggatttcaaggactttgtataaaagagaagaatgtaaaatatctcattaataaaatttttaatattgattacacatcaaagtgatagttgttgattgtattaggtaaaataaaatacacaactaaaatgtgttttgtttcttttacttgtggctactagaaaaattacataggtggcttgcctttctgctggacagtgctgctcttgaaagaagagtcaaaaaatgaactacttgacaaataaatgaacaagatgttttcccacagtgagaactgctatgaagacagtaaaactgggtgatgcaatggagagcgacagagactacgttaaatcaaccagccaaaggaggcttttctgaaatgcaattttgctgacatgaggatgataggcaggagccagccagatgaatttctgtgggaagagcagcattctagatagaaaaatagcaaaggtcccaaagaatggcttgttatcttaaaaaaaaaatggaagggttaagtagtaataagtctgaaggagagttgtatgagaggaaatcagaaaagtaggcagggctcaaggaacttgcagacttggaggtaagatgggatgtttttgaagtgcagccagaaactacagaagagttcctagcagaatgacaaaactgatttacatttttagaaagacctctctatctgtttcatgaggtaggagcagaaaaatgtgtaaagactgttctagtgttgaatcgcagacaagggttccagaggctgcttaaggctttcaaatggagcctctgggggaaaggagaggctgccaagctggtcgactcctctcttggctaaagctttgctgggcaagctctgtccttccctccattcttgcattctgcaggcagttggagataaactaaaagcatcactgttaatgttgtttttcaaagaatggaaaaaaaaagaatgcattataagcaggaaatcatgaaatgtgggggaaattgctttattggcccttggctggagtctacaaattggagcattatacaggaaggcattaaacagggggcgaaagggacatgagtttgattttattagccttaggtgagagatgaaactctttttaaagctccaagaacccctaggacctgagttgagaagagacacagcacaaagcagtacaaatctgctgaagcttcagataatcttgaaaagagtagaagacactgcagctctatagctagagaaaatcaagcctgctttgttaaaaacactgatttgtaaggatggctgtccattctgtaaaccagggtataactcttttacgtgacaagaccattaggaaaaatggcaattagatgagccaggatttcagcagtcagtctagctgaggaaagcgttttccatccctactgcttaccggccattttgggggaccatgatgactgtatgagacagccttagtttgagacagttgctggaacttgactgtcatatttgaagctgccaagcagtcaattgacaatgagttatcaggggctgcattgttttaggccacgtataaagctggattggacaggtatgcagagtggcttctactcacagctgggcagctgtggtttcagcagtccttgtaaaatgccttacttgggagaagagtcttcaaattagagtggtaaagatctatttagtagcaacattttaaacatcacatttgaacaagtattaaatatgccaaagttcagcatttcattcatggtctactctttccctctctactcactttttctaaaagctaagatattacattggtttaaaaaaggggaagttacataaaatataaataaaatgaaatataacaaattctagtataataaaaattctccttaaaaatcattacctccaatacaaagtgagattaatctatctaccttcactgtgaaaagtatatagaaaacaaaatttaaaaattacaatagttctactcatccaagatcataaaagcatgtttgtttcaatgaagagaattgtctgcatttacttggatgttcataaaactgggtttccctatctctaattctttgagtataaagtttaattatatatgccctttctaataacatataaataacaaaaagaaagtaaaatccatattatatcatatataaatagaccaatttttcgtcagtatcagattaaataaacagtagcctgtcattccaaaacacatgcacacacaaatcattatatacaatttgtgggaaacatttaaaatttatttataacgattgggaataaagaaatatgcaaagacatagggcaaatccaaaccaaaacaattcagcagtaacaatattaagattagacaaggggaaatgtcaagtttaaacaccaaaaaaaggtaaaatcagtggtgttagggcgttagctggtaccagcttgtaagagcctatggttaacatatcttcctaactccatgttcaataacatcatattgaaattggccacagtgtgattatttacaccgtagaaattggaaatgatacaaatcagggctttcttcctcccctcctctagagccaattgctaaccatttactagaacaccatgggatagaaatgatgaagttaaaattatttgaaatgcacatgtgctcaacaatatagcaactaaaactataagacaaaaactattagaaatgtaaggaaactttatttaaaacacatgattatactggcatattttagtttatttcttcagaattgtacacatccaaaaactattaagtaacaatataaataaattagatgtaatccataaacttagtaaatgaaatagacagtctttattcattcaatgtaagtgtgtaaatggatgtctccaccttaaaaatgagatattttaaataagccataattgattcaaaatggagttaccttttttggcatcactaacttagcgagtaatcttgtaatcttcctcttaaaatttgtttttgtgaaatcctaattttctatttctttttcttttgttgttgttgttgttgttgttgttgttgttgttgttgctgttgagacagaatcttgctctgtcactgaggctggagtgcagtggcacgatcaatgctcactgcaatctccgcctcctgggttcaagtgattctcctgcctcagcctcccaagtagctgggactacaggtgcccgccaccactcccagctagtttttgttatttttagtggagatggggtttcaccatgttggccaggattgtctcaaactcctgatctcaagtgatctgcccacctcggcctcccaaagtgctgggattacaggtgtgagccaatgtgcctggccctaattttcatttattatacttcccttactatagattcaatacaagggaatgaaagcttagacgttcttggcatattttatgaactcctataaaccccaaccaggttgtgagtagttatcgcttactgagaccttaaacacaaacaatattttaatgttcatttattatcctgaataagatacatagatatatattgggagttgagcgctaccatgtcaagaggagcaagcccatagaatgatttttctttcatttttttgcaaaacaactgcaatgtcccattaagacttttcctgcatgttcgtgtcagatgaaggaaagtattttccactgataccccaggttgttagctagtcccacgactgctcttcaagaaacacaagagacctatctgaatgtgggtaaaaggatttcatgttgctttttacttagaaacccagattgtttgtaataagctctgtctgattccttcaacacttagcatccaggcagttttcttcctctaaacttcaaaaaataggagagaattgtaaggaaaatgataaaagcatctgaagttcagcaaaagtgagcctcatctgagctgacttgtcctgatttggggatagcctgaggagagtgtgttcacgcaccttgcagagtagcccttagcagccacttgaataaaaacgaatgaaaagataaacaacaggagtgggcagaagttcgaaatggaggatgtgtgtgaagaaataataacattgtcttgaagattttagaaaatgggagaggcaagaaaaagaaacatagagatgaatcctggaaaaggtatttaaatcttggttgattgttcataaagcccccacccatagcatcttcatcatccctgtgggatgcaaatattgttgttttcatcttacacacacggacattgtgtttctgacaggccaaggggctgttcaaggtcaaatgactgttgaaggcaaaaccactagtatgcagcagtagcagaaaatgaatgcatggcttctgatgataaatcctatggtcttttcaaaacgcctctgttgtctctagggaaattgcctcaaattagaaatcaacacattctactgcagttctaatttgcacacgcttgcctgaaaactttctaatttctggttcttttttaccacctcctctcccacttaatttcatagctacagaggggaaagatagctactgtccaaatagtcttgctaaaggacctcattttcaaaattctttttcccccttcaagtcttcatttgactcacggtgtaatcacattagtgaggaagattttgtacagtcatacctagtgccaaatatcaagttttcctccaaaaagcaaaataaaatgatgggcagaccacctgctttccataaaattgtaccaaaatcaaggaggacaactctacgttatcacgtagaaataacatcagcatttatgagtaataggtctgtttgatgggcaatgctgtggtgtgtaaaattctgatgacaacatgttgaaaaaaaagtctggaagaatgggagaaaaaaagtgaaagtctatggaaagtagtagatttggagtccttttgaagaaaacatgcaagaagctgccagataactgctagataagcagctattgaccatttatgaactcagttttaccaggcgttgagaaggcgagaatactcaaaataaaacctgcatagattccacccttaggaaacttacagtctggcagattcaaaacaatttcacttcactttaagtaattgtaaaattgcctccataaaagcatagcctggatgaaaacatttttcaatattatttactcattttaatgcactcaaataaactttataccaagtaacttctttaaagatctaccaatataaggcacgtatagatcaaagtagacaatgtcagcccatataatccccttctccaggtccattttgattgcttgtgtcaacattggggaccacagtaaattactaatggtccttaaaattccccccctatttatctctttcttttcaatttttctccttcactcctgctactctatttcttgtgtttttttttttatctactttttttttttgctcttccccagggaaactagaggaaaattcttcatcctgataagagtttttggcaccagaaaggatattttacctgtagtctgacctacatggagtgagggagcctgaacatgtttccatgagtgttctagttcaatgggcagaaagatccatcaggagaaagcctttgtcactgatggctttgaaattgttcaaatgactttgcagttcacaacacgtgagcttaatcattggtttggctcttctgaggagctgagggagacaaagaagcaaagttattttcccagaggtagtgaggcccaagatgctcagaaaagatttaattgaaagatgccattgctgaaatttcttttataatgttctgcctgtggctttccaatagtaatagtagtagcagttgttgtaataatagagatagtagttgtattgatagcaataataatagctactatttattgagcactgactgtgtttcaggcatgggtccatgcactttacatatattaactcatttaaacctcccaacaacctaacaaggtaaagatgattattatcccatttcacaactgagcaaactgggacatgagatttaaggaacgtgcccaagctcacacagctaggcgatcaccaattatacatttcctctctgcaagagaacagtctatttttcaaaaacatgctgataaaacagcaatcccatttgcttctaaggacaaaccctgccatgcctgagtgttgccattcttaaactccaggccagggcttgcctttggatacatgtgagcttcactgggctctctgctcaatgtccctcctcagagtgtctccctaaccacctctcttgatctctctccacccctttattccacttgggttttcttcagcacacttagggctacctgacagtgttagcaaggctacaaagcaaaacaccagatggggtggcttaaataacaatcatttattttctcacagttctggaggctggaagcttgagatcagtgtgccagcttggttcagtgctggttatgggtctcttcttggcctgcagacacagacaccttttcactatgtcctcacatggcctttctgtgtgtgtgtgggggggggtgtgggtgtgtgcgcgcgcgcgcgtgcctgcatgcctgtgtagggagaaagagaaagctctttgcctcttcttataaggtcagattaggaccctacccttatgaccacatttaaacttatttactgactaaaagccctatcttcagatatagtgacattgagagttcaacatatgaacatatgagctgataggaatatatgaattgatgggaacatatcaacacttcaacatatgaattggggtgagggacgcaatacagtccatagtggtgacccagcatatatttaataggtcattaatgtgtttactatgtgtctttcccactcctcccggtattagtaatctaaataccagtaaggatttgaggttcttctttgttgtattcctaatacctaagacactgtcccacacatggtagatgttcaatacatatttgttggataaataaaaaatacagagctccctcttctcccctacatgttggaaaatgtgtgtgatctaaatgagggagagggagaaccatctcatctaatcttccaaacttcctgagccacctttagctactgagcacattcacgtttccgtcagctgggaatttaggtgccctgcctatcatcctctggagcccatcccaggagggggcagaaggaggtggagcagcacactagtgttcccagagtggggagagcagatggagaggagttcatgggaacgatgatttacccctgctcacttacccctgtgagaggacactgccctccacgaatcaatgctggctcctcctccaggaaccaggcttctgcatctcacttgccatgctgtggatctaggaacaaatttgcatttggaaattcattttaaagtgtgcatgctgaggttctggtgacatgcagggtaacttctcccacccacgatatctcttgactcaggccttcatgtaggaggggaggagtgtttggcagcaaaactgggtatttcttaggaaggaaatccttctaagctttatggaaatcctagggtgttgtccctacctttctgagtgtggagcagactatctgtgtacatagcggtagtgaggggtgtaatattggagaatggcttaggtaacagccaaaatatacattgtatatccccaaaaagacgaccaaagactcacaggccatgctgctatcattagatataataggcatagcctttcattgatatgtaaatgttagtatttttggtaagtgccttattttatcttctggataatataagatacaagtaccatgagggcaggatccttctctcattcattttttttcccaagagcatagcacaaagtaggaagtacttgttgagcgaatgaatgatcctaaatatgaaaggatggcattttatcgccattttccagatgagaaaaaaacgagggagcttatcaggtttatatatagtgagtgacaaacttcagaattaaaccaaaatctagtaattcctataacttacaggttattaaggagtccacctgaatgtaagtccaacaagacaggtgtttattttgtttacatacattccaagtacctaagacaatgcctaacatatataaaatacttcataaacatcttcatgtgtgaatagaattttcaaagttcatctcaatatatgcctcatgtgacacttccaacccttcactgccaggtctttcagtctttatttgaataggttcagtaagaaagaattcactcgtgctttagatatgtatggcttttccacattgttgtcagttctaaatcccgaaagttatttttgtatgcttggaatacttcacaatattcacaatttttacaataaaataatttcaggtcttcttgatgaaaaatgtcgatcaggacagggctgaggataatcacaaggcttgaaattaaagaagtctccttaggctgaaatgaatttctagttgtaaaaccaaatatgaatctatgtatttgtgttcctcagaccacttttccagcaggtccttggctgtattttgtatgcatttgtgaaatgctttgttgaaattcagtttcagccaggtctgtagcattctcctggcccctggtctgatagttgtaccaggaacactagctaacaattgcatggcactagtctcagctggatttgttctaactcttttatatgtattaactcaatccctacaaccaccccatttcattactatgcccacttgagaactaaaaacactgaggaagagcgaagttaagtaacttgcagaggtctcagagctaggaagtaagacagccaactcggaacccagcagactagctctggagcctacccacctaccctccacaccgtacctgtggtccatcctcaccaaccaggcctgctgccctgagcataacttcaccctcttgcgttctaaaactatctgctgattaagtgagttctgaaatgttttcagggaccaatactaaaatcaactatgaaatagtttcagagattgacctttcctccttttggaatggataagattttcccaaccgaggtctcccatcagctctcctgttcccctggactgtggcacataggagggccagggacttgcgcctattatttcatttcttttgttatccttcatttctagatctcttctctaccacaattatctctcatgttgacagtttccccacagatgggatgtctatttccttgataatacagcattattatgctaaaatctctcatttgtgttattagccagactctgtgcaaaaacgtgtgtatatctgagactctgtgctgttcttagccaccttcttggtcccttctcatgtaaattactagggcacttcttcaatattattattatcatgcccccttaccaccaccacaaaatcttccatcataacccatttttttttcctcctccttaccacattttcagctttgaactcttataatcagatcaggaattacatttctgaacaaatgcaggctttgcagcattgtgaagtgcagctggtccccagcagagagccctaagcccctgcctgaagccaaacccccttttgtggcgagaggtctggattttatttgttgtttttatctttggtgaactgtcaactggaagcagagatgcgaacaccagttatgtcctcccctgcaaggttcatgaccaatactttatagtttctggatatgcttcctaggtttcttctgttggtgtcatttgcctgcatgtgactcactggcaggtggtgatttcatcatattctagacatgtgtcttaggaagctggcccctatcctggctggctggacacatatcgaagttccttagatctaccattgtcactttcatatccattgttaaatactatagatagcatgcaggggtcagccaaattgttctgtaaaaggctcaagcataaatattttaagttttgtgggacagacagtctctgtcgcaactacttgactgatgcagcatgcaagcagccacagacaataagtaaacaaatgggaatggttgtgtcccaataaagctttatttataaaaactgtctttttttataaataaaggagcccatcgtttgccgccccctagtgccaggaaggaacaaggggaaaataaggaagagacccagaggaaaaaaagtgtcaccaaccatatctctaactcatatttatttacttatttttctaagcgcaatcgctaaattatctcgtcttcctaaggcgtatgaatctcttacattaacttagggacagaatatagagttttatgttatcttctgtgagttctttttccattctgtcatgtttcagactttcagaggtaatttttaagtatttcagctgtgccttagatacattaagggacctatagtgcctccctgaggccaagatgatggttgcaatcataaataggttatttctgagttgagactggtaagaacagattatcctgcccagacagtgatgtgccaagcattggcaactttgaaaaatttgcaatttgattttataggagagtttccttaacaggcctgagtttttttcccattgcttttgtgaatacagtattttcccctgctagactcttagtcaaatgttcttgccattataagaaaaaaggaaaactgaaaaacttgaaaataattttattggcttaggaattattttcatgtttgtctgctaatggcaaataaatctaccttattgaatcatacggattttaattccccgggggaaaggtaaccaatgacaggcatatgtgtgtgtgtgtgtgtgtgtgtgtgtgtgtgtgtgtacaagtgtatgcttgtgaaaattgaacagcaaaaagaaattaggtggagaggaaaacattaaagctggtactggtgggtaatcattatatatagtatatatacacatatgccttctccagttttatggaggcagtcagtgcctcaaagacgtgtaataaagagacagcaacaattattggtggcattcatgtaggagaggcttgagccaatgtaaacttgacttggttagtaatctttgccaaaactccctgattgttgtaagggagttgtgaaccattaggtttgcttaaccagaacagcaagtaagcatccaaacagattgtccttggaccataagcaaatgcccagaaaatagccccctgcataggatattaagtacttagaaacaaatgagaaaaaatattacagcaagtcttccaggtatagaagggataaacaaccctattggtatcagaatttaggaatattattatgtctcccactttaaatgaaatacagcagcctgacttggcaaaatttggggaacggttccccttctttgcagccaggttcggtgcttgccctctggcatcccttcaattgtgtatattactggcagagacagctgtttgagctgctaataagattgcaaaataatatcagcttgtgcttcaggttgaagataagagataacattgcattggctgtaggaatggctttcttataaactggatttagttttatctcacttgtctcacttgttacttttttatttatttacttttttttttttgagatggagtctcactttgtcacctgggctggagtacagtgacacgatcttggctcactgcaacgtccgcctcccaggttcaagccattctcctgcctcagcctcccaagtagctgggattacaggcatgcgccaccacgcctggctaatttctgtatttttagtagagacagggtttcaccatgttggccaggctggtctcaaactcctgacctcaggtgatccgtctgcctcggcctcccaaagtgctgggatttcagattacaggtgccatgacgcctggccccacttgatacatttgagggtctcataaggtcttgaaattgagcctgtgaatttataaacagggctacaaccatcctgcagatgcaactttttggcatgccagaatcagtggcacctgaagagcatctccttgaaagcggtagtagataaaaggagatgcctttcaggtttcagacgtggacctcagattcacctccaagactagagttatcacagtgcacaggatcatccaagaacagacatgcagagggaggaaaggccattgtaaggctcaggagaacatagtagagcctaaaaatgagaacaaaatggtactatcagaaaagatggcagtggttgggacataagagagggtaggttcacaggtttgtgggaccaggactcagtcactttcctcgcgctaggctcaaccctcacgatggggaaagtaatgtacttctgggcttaaaattcttcacagtcaactggtagagatatgagggaatttattgctaagtagtagggaaagtgttttcacaaataacatacaggaaattcccatatcatacaaaggaggttgtattatcaccacgtttttacatatgagaaaatagagtcttagaaaagttatgtaccttgcctaggagcatgtgcctagatagtggcagctccaagattcaaacctaaaactccagagtctgaaactcacacagtttcttctctgttctgaggcttcatgcagctggacaggaggttagcctgagacaagaggaggatcattctcgaaggcagagaggctggggacatgactgctttctggaaacctgagctcatggagagaggctgagagtcaggaaagtaggacatgaaatcatttaatgagagtgaagaccagccaggtcagggagtttgaaaagagagttttgaaatatccattgtagctaatatgggagagcattctttgagagtgattaaaatggcgactgaggacacagctaaagtgagaaagaataaatctgtggcagacttgcatatttttggtatgtgcatctctttccgaaatcaattgaacagaggtgggaaaagtagcttggtggataatgaggtagagtggaaagttgaaaagacagagcttaggagtctttctgattggtctaaaattccccagggaaaatcatgtttctttttatgaatatagtccaggtcttaggtctgtcccacggcacaaagttttcaggacattctggacaaattcacacatttccctggatgtcagtcaattccctttgcctctgtgctatcactttccttctctctgctttctccttgagttacctgtcccagctcttcactccacattctgcagcctccgtttagctcctttatacctttgtccagattcttcctaacttattatactgcctcctcatgtcaacttccatcccatctgcatttgggaaaagaagcccacatgataagtgagtccatctgctaaatgtatgcatcttagagcatttgttcaagatcaataaagatacaaattattttgatttttcagctgttgcccaaatccacaagagtacacaaatgaaaatgcactgatttttaaaaagtacaaatagccattaaagtttgtattgttttattctttaaataagccggaaaaatgggaatacgtaggaacgagggagctagcaaaataggcggggcttctgcgtttcaggtggtctgagactgcagtgaccctgaggctggtggacctggaaggagccagggagagatggtggatcccaggggtgggagcaaatgcatggtccaaggttctgaatggcagagctagaccaaaggactaacctgctaaccttgaccaaggagatggcccagaggttttctatttctactgctccatcttttcattataagttcccagtagaaacgagtcatcatttaaaatatcggtgcagcacttaacacataaggaaaaatcaataacattcatttacttacagtacccagagaagaaataaattcaaatacgtaaaaatgggcatgaaccatcctgttccatatcccactttaggactgtcagcaactgtatacattgctgaacgtcattgctcttgtacataatgaataattttctgtaaccctgtgaaggccgactgatttttacggaaagacagctttgtgttaggcggcccgccttccccacggaatcgggttttcccacgccacgttttgatgtttctgagaagtgtgcgccatctgctggccgctgagaggattgacgagcagccataaggagcaccgtgtttcttgagcatgacttaaccaggcaatggaattacaattatctttgggtttctaaaacataatagacatttcaggattcacgtgacttatgagaagtcgcttaattgcctttcaagcagtatacattttttattcaatatgtgtattattctttgtaataataaacgatgcaataaagcaatcgaggggttcccacatgctctctaggcagagatggaccccgggccctagatgaaaggttaatagtttggagtgagcactaactctggtcctctgactctgaatctaagtcaggagtagaatagagctgtacaaagaagactgcttgatggaattgaattttgtcccttcttcaatgggggaaaataaagtacagttttcatcaatagattaatgactaaacttggaccttgatgccaaatccaacttgagctccgcctgcacagtctggagatgtacataagagacacatgctcagcctcttagcacatcgttataatccaggcaggcaatactatatcctaaaattactcctctttgctgaaattgagaaaataggaattacccagggtaaatttggtacataaatgtaccaaatggtatgatttattctagtactgtcttctttttcttgattttcttctttattgggaaatttgtattttgtagttccttcgacactttaaaaattaaactagagggtaagatttaagttttctcacaactaacaaatgattttgattttattgcccaaagccctttatatctcactttcgatgggtctagtccctttggcttaatttagatgtgatttttccttaataattttgaaaatggtggtgctctataccaactagctagaataggaatcacattgacagtatttaatggatagaagcatctcaaagatctttgcttaatgagggcaaatcattagcaatgtccaactccctatgttagaggcgccaactaaggcacggtacttaaatttaaagcacaactcttcgacttccataaagtacatatattacattatatttttaaattacggggtagtgactcgatatgtcactggaatgttttgaatagtgcccccggcccccctgccaaaaaaaagaatgcaagaacactgtcctaaccaagaaggcctgggagttttaactaattcagcctttcagcctccacttaaaattctggaagacagtagtgttggtgctagctgtccttggctgcaagttgtctttacagaagaacttggggtacattttggtgtgaggccactcttgcaagcagcatttgcaggcattaagagaatgcacacagttcaataagctggggttatattcataatcagtctttgtttaatgctgtaaaaatactaaaggaatggccaaaatctctcggtatctggggaaaagggttctttgaaacttttgatgtgtgagcagaataatggaaacttatctgttccccatgcttttaacacacacacaaacacacacacacacacacaaacgtcatagatcaagatgtaacaggttggaatggggcctaggcttgggaattttgtgactccccaggtgatctcaatgtactgctggtttattagcaggctttgcccaaacaaatactctttctcacctaccaggagaaatcaaagagctctgggttaaacacttgtatgttaaaaccaaaatggtgggcattgcagagtagaggaattaggagaagaaaatagatattgggtcaaaaattggcctcaggaaccaggaagtaagaatggccaatcttaaaagagaaagttctgttgaagagggagcattatctgaagttggaatgactatggaggacaatgacagctgtcccacaggatgtcactgggctgaggaaaatcagactggaagccacaagcccatgggggctcaggaagcctgtttcctgagcagaacagagctgggtttggcacatgcctagtgttccagtgaaatctgtcatttttctgcttccactttttacaaatgagttattcaacgctactttgttgacacatggactcagcatttaaaaaatgacagtggagataagggtctaaggtagtgataggcaaatgaatgatgggcatccatcatctgaagagcttcttaaaattcagatttcccaaccccaccacagacgtctgtctccgtaggtcttgggtagggctcagagcaggctgcttctgaaattttgaggttgtgaggtaagaatacaggtgggagcctgcataccacttgtctaaatatttaaaagttgtaaatcagcctaatgaactgtgaaggaagctctggcctacttccttgacaacttaagcctatacagagacctggaagatcaagttcaaatgcagaacctgaatgtttcggttctatctgctccctcagtgttaaaggtctgtcctttttccttgacaaatatgctttcataattgtctggaaggccggattccaattcagcaattccaatccctcagtgttgagggaaagggccacccgctctgctcttctcttcccatctggctctgtctggaaccacgaagcacctctgtgtgtgtgtggggacaagccagcccaggtgcctgcgttttggcccagtacctcctaccctcatactacatatgtagccacccccaggcatagggttgtgcacactggtgacatgtctgccctctagaagaagcatgggggaaatgggaccccacaggccctgttagctgatacgggccatgagctcccaggtcacggtctaaaagtacattggtttggggctctgcgtgaccatattccaaggatcctgcaaaggaagaggcaggactggagaagggaaagagtgggccttctaaggctcccagggcaggacctctttttgtctggtctaagaggggtattgaacccaagtggcttagatgctgaatccctgggcttagaacccaatgccctggagcattgatctcacagtgctggccagaaaggggctcgttggttgctactaggtcattatcactcccagggcacctgggcagtcaatgaaactgagctcagaaaagtcctgcctttatgatgtcccttccacttccataactttctccataaaataaaaccaagaaaaataatttttctcttgatttcaaatcgtatttaaaggaaaatagaaattttatttttaaagaaattgcatgttttcattgtctatatattgttttgaaatatgtacacgttgtgtaatggctaaattgagctaattaaatgtataacctcacatgcttatcatttttgtggtgaaaacacttaaaatccactctcttaacaattttcaaaaatatttgaaaaaatatagttattaactgtagtcctgtaactatttcctattaattatagggaagtagaaattttaatagtcatctttctcatgcttttcttgacttttagattcaagaaataataaacttgaataaaagagattaatttcacagtaatgcaatatttctgtaaaatttcacaccttgttgactgtcaatcagctgagaactttacacctcattaaaaatccattagaacaatggctgttccattagcccttcagtttatgccttaaaacatacttgtctaaaaacaacattgtttttggcaggctgctccttttgataagtggggacttgctctggtattaactgtttccaggtctccagaaaaaggctcagggtatgtctagggacatcagtgacaacagtgaggtagagcaagtcaatactgtgccacctctgcgctagccagagaacctctgctccaaggtgagttggttccccctttcattaaggtcctcaggccccagtaaaatccagatatggctttggagaggaacgctgtctgagtgaagctccctcagtttcataaccagcttagagcttctcagctctgacctgcctgttagcatggctggggagcccagtggtttattgaactggctaataacaaagattctgagataacgaaacagaaaacaggtaggttttgatgaaaaggaaggagataaggaggataagaggggtagtagggaggaatagtgggagaggggcaaagaagcattaaatcaagatttggagaatggctggaaacagtggcagagactcaataggagagtgaccctgacagacggggaggtggcaaaagtgcttgcaggcacaggccacccaacagttatttcggggactgttcacaatctcatctacttcacagttttgccttgtcctaactcaggtcttattagagccagaataaattgccttgcatcgtcagaaactgaccattcattcctgtggtcttctttgagatttttagaatcccaaggactaaatatccctatccacttgcctttgttcactgtattggatgatgtgccattgcctgtctccagcattcactgagagcagtaccccaacatccaacacatctttaaatgccaaagggaagtgaaaatgtcctgacttcttaaactctaacatagcattcatcctattcttatattttttgaactttgcatcaaaacatacataaatgcaggtgcacaaattgtaagtgtaaaagtcaatgaattttcactaagtgaacacacttggctcaccagaagctaaagaaagggtgaactagaaggggactttgtagattacacttcctgacaccatcattatttaagaaagaactgtttcctaggtatattttaggaccttttatctggtgatatctatctactaactttaggggtggggtggaattgattctttttacaagattagtgaagctagaaacaactagcttttaattcattaaatgtaacctactttcaagtagcttcatgtgactgaaatcaatctgttttattttccaaaccagtggaatacacacagggtcattacatacattttgaaagtcttctgtttcaaatgtattgtagattaagaaacagaatgtggcagggcacggtggctcatgcctgtaatctcagcactttgggagaccgaggcgggtggatcacttgaggtcaggaatttgagatcagcctggccaacatggtgaaaccccgtctctactaaaaatacaaaaaattagccaggcatggtggtgtgcgcctgtagtcccagctacttgggaagctgaggtgggagaatcgcttgaacctgggaggcagaggttgcagtgagctgagatcatgtcattgcactccagcctgggtgacagagcgagattttgtctcaaaagaaaaaacaaaaaatagaaaaagaaacaacgctattggcacacccagaataatcactattggacttctgataccaaaaacaagggggatttcctcgtttttaagttttatgaaatgaagtaatattctgtatactcttccgagtttagcttctttgagtaggtttgtgagatttatccaagtgtggaatggagttataatttattcatttttggttttgggtgattgtatttttaaaattaaggtaaacattaaaagttagggtttaacccactactgggtattcacccaaagggaaagaagtcattctacgagaaagaccacatgcacaggcctgtccaattcacagttgcaaaaataggcaaccaaacttgttgcccatcgaccaacgagtggataaagaaaatgtggtatatatgccctatggattactactcagtcataaaaagaaaccaaataatgtctctggcagcaacttggctggaagtggaggccatttattctaagagacgtaactcaggaatggaaaaccaaatatcatgttttcacttacaagtgggagctaagcgctgaggatacaaaggcataagaatgaataatggactttggggatgggggagagattgggagaagttgagaaataaaagactacatattgggtacagtgtacactgctccggtgatggatgcaccaaaatatcagaaatcaccactaatgaatgtgtccaagtaaacaaaacccactgtaccccaaaaactatagaaatagaaaatgaataaataaaagttagggattaaaaagaaagtgggacatggtcattccagaagtctaaaatattataagctatatataaaatacaagtttgtaactattttttgagtacctgcaatcagcaagtttgcattaatattactgtttactccctcactttttaaaacaactaattttctatttcctattttaagaccttacctaagattgctgtcctgtggaatggttcctagcccacgtgaccttgtctgtgttgaagcatgagtgaatacatactaccatctactttagtgaatgttgatgataaaatggccaatttcatgtatttgtttattttcaagaaaaccttagagcactcgttctcaaactttaggatgcatcagaattacctggagtgccagaatcccctgaagtggttgtaagaactcattgctggggccaggtgcggtggctcacacctgtaatcccagcactttcggaggccaaggcaggcggatcacttgaggtcaggaattcgagaccagcctggccaccatggtgaaaccccttctctactaaaaatacaaagattagctgtgcgtgatggcgggcacctgtaatcccagccacttgggaggctgaggcaggagaatcgcttgaacccggggggcggaggttgcagtgagccaagatggcgccactgcactccagcctgggtggcagagacaaattgaaaaaaaaaaaaaaaaggagtttctaggccccatccccagaatttttgattttgtaggtctgcggtgggatccaattatgtaccgtctaatgagctcccaggtgatagtgacgctgcagacctggctccacattctgagaaccactgccttagagcctgcacatcaagtcacgtttatattcctgtgccgtactcccctggtgaggattcctctggtcattcatgcatttacgtttttaaactccttggaatcaaccaggtagagattgtactcttgttgtcgtatttaccatcctaaatcattagcatctattatcttcctctgccctacaccacaactctgcttgtaacccatttggagcgtgttttctatgttcttgctttgtttacatattggtggccccaactatttatcagcttattaaagacatcaggccactatttgtctatatccctgcactgcctagcagggagcactgcagggactattgaattcatgcactgtattctctgctggcccattgatttcatccttatagcccctgcttctcacctgcatgtgtttttttcacaatttacatactgataaaatgaattcttgcttcttgctcatgtaagaatatggaggctgggcacagtggctcacacctgtgatcccaacactttgggaggccgaggcaggcagatcatgaggtcaggagatcgagaccatcctggctaacatggtgaaaccccctctctactaaaaatacaaaaattagctgagcgtggtggtttgcacctgtaatcccagctatttgggaggctgaggcaggagaatcgcttgaacctgggaggtagaggttgcagtgagctgagatcacgccactgcacttcagcctgggcaacagagtgagactctgtctcaaaaaaaaaaaaaaaaaaaagaatatggaagttataaaaataatctgtgatcatataatgactgttttccccaaaaagggcattactttcctgcttcaaagtatgtatttcttaactaaagtgtttgtgggatatggctgcgtgttggcatcacctagagaactttaaaaaaaaaatgaaaacaaaaacaaaacaaaacaaaaaactgatcttcatgtcccagaggttctcttctaattgatgtgggctgtgatctgggcatagagattgccaaaattaccccggtgattctaacacataaaaatgttttagagtttcttaagtactttttttcctgatgagtttcaagagggccactttttttttctggaagattattttcagaaacacctagcccttctttatttgtatctcctgtagatgttttccttctgagtttttctctgtgaaacaagaaaatataatgaactgtcatttgcacgttgcacaaagcatgaactttatttggagtcttagataaacttgttctgatctagaaatgaaaaataatgaactctgctgagttctgcatttcctgtctgaagttagctttaccataaggatctggtgggtaagtgtttgttgttcttgtcattaattattggaacagagttgtttggagtagatgattcattgtggaacaaatcgtctgattttgagggacattttccattataaaataattatacataaaaacagaagtattgctttaatactaagatttgtaacaatgccatgtcattctggttgtaatgactctgtgtctattccactggtttggaaaataaaacagattgatttcagtcatatgaagatacttgaaaataggttacatttaatcaattagaaactagttgtttctaacttcactaatcttgtaaaaagaattaattccaccccactcctaaagttagtagatagatagatatcaccagataagttcctaaaatatacctaggaaatagctctttctcaaataatgatggtgtcagtaagtctaatgtaagtccattttattttaccctttctttaggttctgcccttgtatcttagaataatgaaatatgaagtgaaatttggtgtcatggtttacctgtagccattttataatttagattcatgggtttacattacttactgaaactactggggaaacattaacaacacaataggattcctagattgataaacttcaacactcaagctatgacagttgttctcagtctcgtctttgattcaatgtaaaaatttggacaagttaattagctttcttttgctgcgtgtataggggcaggataaacttgagaattcccacaattattcaacccagatcaaagatatttgtctcaggaaatcaacaatattaagaaaaatggctttttgaaaaaaaattaaaaaaatgtttagcaccttcaaatatcagattcacatcctcatcatcctcacttagagattttaaaactaatagcaattttgtatggcacatttgcatttacaatgcatttttgtacacattctattttcccctaaacccagggagactggaagagcaacaatttacatatttgcgtatttttagaaagtgagtcttagaaaggttaagtgactaacctaggctcaaacagccagaagtgtgtggaacaaaggcaccacacagctttgctgactgtgagctcactctttctactcctccagctatgccagctatacaatagcaacttgtgagaggtgttaggtgtgagggatagtaggggggtaggggtggggaggggaagaggaagcaaagtcctcatactgattgtatttttatcacttttctaaaggattttatgttttacagcctatttgtcattggtggaaatatctctacactggtgctataaacagcaaaacatgcacttgagactccctgcaagcccatctaagttttaagggtaattgagaatagcagcacttgatacacatatcttcatttactatatagtgtgatcaattattttccctgatactaagggaaaattaaacatcttttcattggttgttgcatttctttcacggtgtttttaatgcactttgcgagcttttgtagttctcaaaactggccactagatggtagtgtttagttagtattgtcgcacatgttccattgtgggaactttgattctaataggaaacatttcatatataatactgcactgaaactgtttccccagtggctgaggcacacgataaaaactctgtggcttgagccttctttttcttttttaatgactagacctcccttcattcaacacagacctttcttccacatactacttattcagcaattcatttttctccccataatagtctttttaaacaccccacagtgagggagtgttaaaagtcctgcctttcgtagaattttgctctaaacttctgagaggtaaagcagatctggtgccaagatgatgtgttctagggaagtacaaggacaatagacttaaagacctgtgctgccagcttgtgaataattgaagatttgtatctcgaagtaaatttcagagtacccctgtacttccttgggtatctaaaccaaataagacagaagttgtagttgcctggtatagataccacattgccaaaattttacagtattttggacaatccaatagatgtcttctctctgctttgtttaagccttctaatttccccagcaagacaaagcaaaacaaaattaattcacacagcctgtttgcatgatatggtccgatggtttactatgctatgtttgtcattagtcacccaagcacagaatctaaaagtcacttataaccatttcctgcccccccatgactgctgattcttccaaaaccataaatctcctttactaattcacttgaataaccaaacctgcatttcaggttctcattctttacacacccaataaaaaatgagatgccatctgttattttattcattaagtcaagttctgtttctcatgttctgcgggaattcttcccatgtggttttactgtttgtttcactttcttcaatttccctcatcattacacataagcatttataaaatacctcttcataaaatccactccagtcattctctgcagttaactccaagatctccaagatcaaaacagaccccaaagttgtcaatgaaactgttcacttgcacagtgcaggggctgggggtgtggttacttgggtgtgtgaatatgaactttcggttgtctgaggacaacaggaagccttgtttctggttgctatcatattaaactttagttaagatttttattgtttatgagatagggaattttttcccctgggggtcaactggggtcaccctatttcctgagggctaaataaaattggctgcaatccccatcgtacagattgtgaaaagttctgctttctctccaaagcttttatgaatccttgatcacaccaggccccacatctctgcttcagccaaattggttgcgtttaggagttctctcacagtagctgtcatcatctcttttttccataccacagaggctcaaggtagaactgagccccttccttagttttcccaaccaccagccttccctctgccccaacaaaacaaaacttgttcacacatgggatttctgcattgtaccacactttactgatggtttgaagaaatggaagcaatgttcaccataatgtgagaagtgactgtgtttagactttcatattcttaaaaagtcagttacccagtgatttctatatggaaggtgttagccttttgctaggtttgcttgggttttttctttcattcctacccttccgtacctctcctacttcaaaaattgcttataggaactccagatttttcttacttaatggcatttagtgctttacgtctctcctgctccatccaccttttaactcccagaactacgcaagtgctcagcagaacaaaatgggctttcatgtaatattaccacaacttgatagaagatatttttggttataaatagcttttaaaaaaaattttttggtgattacatgtgggtacgatgactaaattgaattttgctcttcgtctcatacacacaaacacacacacacacacacacacacacacacacacacacacacaggcatttatatatagagagagagagatggagacttgttctgtcatcccagctggagtgtagtggtgcaatcacagctcactgcagcctcaacctcccaggtgcaagtgatcctcctgcttcagcctcccatgtagctgggattacaggtgcgggccaccacacctggctattttttattattttttgtagatgcggaatctccctatgttgcccaggctagtaactcctaggtgtaagtgatcctccagactcggactcccaaagtgctgggattacaagtgcaagcccccatacccccagccttctgctcctatttgacctagaaattccatatagtagccatagcattcattcattcaacaaataattattgaacacctacttgcaaaaaggaattcagttcctattctgttggggtgataatctagtaaataataataataataatgaaaagtgtccatgcactcttctaggctccaataatccctatgaagagagggtatgcttaaacaacagatgcttattttctcacggttgtggaggctggcagtgtgagatcggggtgcctgcatagtggagttctagtgagggctggcttcccctatgccttcacccaaagtttatgtgttattaatatcagcagccctctatctctggatgtctctggtgccttagaagacatattctctacagttaaagagtgatcctcaagaacggacagggtaaatatattttatattgctaaatgcccccatttgaagggctatataccatttcatgtagcaaggagcacttaatggctccagcagaacaaaataactctacagaaaatttttatttgcccaaagcatctaacgagctggtccttccatgcatgtggtggcactcttgtgaactgcttcctgagatcctcttagtgcaaagccaacaacattcagtacatttccttcacttgccttttggcatgtccatgacaatatttccagctgatctaacttctagaaaatctatttcccacaagcaacaggtcttctattttcctgcttaagagtgtttatttttgcttttttcagcagcttcacaacttctgacttggttgacttttttttttttttttttagagagaatgtctctcctccatctgcgaagtgctgcattttaggtttgatctgacaatttgatgcaacggctcaggtatatatgacaaggaaatggaatttctatcctcgaaatcaattctgaacaataaaagctgagaggataagtttattcaaaggtgatttggtattgcgacaggctgctccaaatcagaactcagcaacctgattttgaaaaatttccaagttcatgaaaagaatcactttgtacataagggctttctacttgtttgggtttgagcataactagatagcttagtgggatatccatattcttgcatttgatgatcacatttggcatctaaatattatgctgttttcaaatgaaagaaatactgctgaataagagagctagaatgaattacatacaaagaaaacttaaaataagtgtcatctaagaagatgaaaaagcaaacaagtacatatgttcttaacttttgggggcttgcctttaatttttttaataaggcaattatctgctattagtaattataataggagctaaaatccagttaatagtcactgtgtgtgaaaccctgtgctgagcaccccagggtatggcctccaagaggacacacaacactctttttggagaaagctgaagacagtgggggcagtgactgaaggtcacggagttggtaaaaggcagagccaagctcaaacccacacagccacatacctgcaactgtgttgttagcactgcactccccagttaccaaagccttgtttattttccagtcctaaactctgcttaaatgtgcatgaagagtaatttcattttttttccttttctagactgtaaatttgtataattggatttctacaggcttttgtgtttctggtgagattcaaaatggatttttcaaagttacgatattcagtgactcctataatctagaaatttctcccaagacaccagacttcctccctgatcttttgactaaaagcctggtccccagctgtattcatttcctagggctgctgtaaggaagtatcacaacctaggtggcttacaacagccaaaatgcattgtctcacagttctggaggccagaaatccaaaagtaatgtgttgtcaaggttgtttccttctgagaaccgtgaggcaaggatttgttccaggcctctctccttggatagccgtcttctctctttgtttcttcatagtgccttcctcctgcatatgtgtgtgtctgcatttccccattttataagaattcccctcacatcagataaggcccactctaatgaccttattttaactcgattacctctctaaagaccctatttccaagcaaagtccctttctgaggtactggggttggaacttcagcctatttttgcagggacacaattcaacccatagcaccagctctgaaccagggtagtgcatggaggtggagacctagtaccgtgctaaggaccccagccgacagtgtggtccgaggcaagtttcccttctgcccaataggggattggattgactgatttctactgtaatatagtacaagtatatatagtagaagtatatatatagaagtaacatagaattctatttttatagaatggctgtaatttatttaataggttttctcactgaagtaatttcataaaagtttttggaaagttggcttcatccttctactttcatgcatttgccgcagagattaagtgtctgccaggtattctttcagcgtgatccaccggggaacccacagacccagcctcctcccactttccttttccttctgagatctctttattcttcctgttctgtgtccaaaaagaggaaccaactgccccctaagtctatcctcacatatagagcctcttacatgacaggtgtcaggagaaactaaaaacgattagacttagaaggagctaactattaaatggtgaatgctcaatcaatattcattaatcaggaaggttgaccattgactttaccctctgtgacttcactggctctttcacagcaacgattcttgagaaaatacatggccaagccttacattagctgatctagttttcagagccccgctaggatatgagtcctggtattgcagatgaggaaacagggtctcacagatacacagaagctcctctgggtgcacacagtgagtactgggataggcaaaggctgaactcaggcagcttctctccaggatccaccctgagtgatgagctgtgtcccaggctggagaagagccatgctgcccactgtctgggcctatctacaagctctttcattcattcttggatttttccagctgaaaaaaagtgttatatgaaggatcagagatggcatcttaaacttttttttgcacaattcatcattaattcactgttttttaaactgttgtcacaaagagttgttttgaatgccttgatgaactatgttttgtttgttttattatattttcacttgagatttttactgtgaagcatgctattttgaagacaaaatttttaaaaatagagaagggcaagaagaatggtggacaatgcaggaggtgacaattggtataattacagtaaacatttataggtcagtggaacataagccctgagggaaggctctgaaagcggacctgcaagcaggagggagggagggaaggagggaggcagccctcgcaggctgccgggaagcaccagggatgtcgtgcctcactgtgccagcctcacagatggcatctcagcgacatggctgttcttttgtcttttcttcatgagcatcttagagaagcgcatttatgcacatttctacctacaaagttttgcctcagtgtgactcatcttctttctgtctcagataggattactcttcaaaggaaagataaaaaaacaagttctgaatataaagatgaagccaactgcagggcttgttgaattacctcagagatagctagagttgtctgtgtgtgtgtgtgtgtgtgtgtgtgtgtgtgtgtgtgtgtgtgcgcctctgtgtgtgtgtctgtgtatctgtccatgtctgtgtgtatgtctgtgtccatgtctgtatgtgcatctgtgtgtgtgcatgtgcctgtgcatgtgtgtctgtgcatgtgtgtgtatacacatgagtgcaatgtcccatattggcaaataccacatggtaacgtcctgcacgccacaggagctgtatatatgagctgtattttcatgatggcccactgggatagggattaaatcagatgatcaccatttatacctaagtagtaacacttaaaaatgcaattgctctctgtcaccacggcttaatctatgagcccctaaggggaaaaaattcttacattaaaaaagccatttcatatatagataaatgttgaataggcaggtgttgatcagaaggtctaatccccatccacgtgaaatgaacaagtcaagcagataattgttttactagagctttcctttgcattaaatgtgcctggaaaacatttctaaaaccattcttttctttttggttgaaccattatgaatgaatcttcatcctttaaaaggctagatgttcatgttcaactgttttggcaactgacctaaaccaatattattatgaacacattttggttgttttggttggacattggtaactgccagtgaagttggaggtgagaggagttaactacttccttataatgtcaccacctaattagaataaaagcatcttagattaaattctgatttacataaggacatttattaactaaacaattattcagcaggcatgaaataaacaaatcatatgactagttctctctctaggtgcttggccaccgtttgcaagcttcccttaaggcacaaaatccaaaattccagagtcaatatttcatcatcactatagacaaaagtttgtggtattcacagctggacgctggacatctcccaggacgtggttcctgagtcattctgcctctgagtgtgttgctcccatggaaatcatgcacctccacggaactcactcaggctcctcggggactcctgagtctgcagtcagattgctagtcttgctctgatttcctacctatcggacattccatttgactgtcttgccactgaactcaatgggtgtaagctgactcttcttccctgcatatcagcatcctcctgacttccccacttctgtgaatgtcatgatcattctttctgccacctaagcttgaagcctacagtcattttttaacacagccaccttcagctccaattccaattccaatcagtcactcttttctcaaatctcccttcataccagttcctgtccttctgtctcttctaccctaagccagagccatatctctgcagatcaagggcctttttgttctgtttcttccccagtcaattagtttacatgatgccaaacccatcttcttaaaaccacctggattagatcactcctctgtttgaagatttccaaagaggccttattttgtagtggaaaatgtccaaactcctttgcatattcacttattctcagcatgcttttaccaccttgcgttcttctccttcacggcacaaacctctatgccagctggattttccatccataatcccccaaatacatcacatgcattgttgcattggccacccttgttagtgctttttccatgtggtgttcttactttcctccttcactccatgcccacttcctcaaaacacacacacacacacacacacacacacacacacacagcttcttggagcctcaaagttggttgctagtattttaagtgcccggaatttgaaatgaaaaaaaataaaagtaaactggttttaaatgtaggcgttgccacgtattggttctactgtggcctcagacttgttatgaaatatttccaagccttagcttccacatgagtacaatgggaataatgcctaccatcctattgcccatccttaattaatcttagttccgtttctgtgccacgtttcctccccagggaagccctttatacccttactactcatggatttatctcttctctgagcccatagaactgagttctgttgtcactgctttagtaaagtcaccatttgcttgtttaaggtccctcttctattttcacttattgtgtttcggagccacacattgtatcctatactagactttgaaaatactttagttgcagtgcattatttttgtgtagtcagagtacccagggcagtttctcacacattctctcgttttgtctcataacatcccaggagctggatataatctgtgatttatgaggagagaaagtgagagacagaggtgtaagtgagttgcctaaggtcactcagagagtgagtggcagaagcagcacttgaatcaagtcttaggattctaagcccggggctgtctgctccctcctagacctgtaactttagaagcaggaatttatttcatattgcttatatttcagtatttatttttaacccttacagggcccggtcttgtgactgactgtaattgagaaggtactctacaaatatttttgaaagaataaataaaatgaatactacagaccatgttaataatgtcaaataactctgggagtttgagggataattctgtcaatacgagttgagggtgtgcttggcctctccatcatttaccctgcttttatgagggttagcagcacaatgtcttcattctaaaacacagaatcatgaggttaaagaaagcatgcaatgccatcagctgagaagaaccagaattcacagtgcaggttctctaaagtggttttgtgttgctctcagcgccgtgaactcccaccattatattcatagctttttagcctttggctaagatcaagtagagtgtttgttctcctggcttttaataagtaatgtgttctccatccaaggacaacatatttaggctgtacatgcattacgaagtattaagctcctgtaacagtaaatttctcaacaggagatttatgtgaattctcttggatgttattctgttgacattaggaacaattaggaatataaaatgccatggcagatttttctgtgatgctggacgtactgtcaggactctgagtctgtgtactcggaagtcttcctcagacagggacaaggcgcattctctttcttaggaagagaattaacagtgcactcccacctccctgtgctcaccacatgggcacacatcccagggcgagggtggagtgagctcagaagaacccacgctgagcacaatgaaagcaaaattattatcagagaaagaaacagattgcagcaacctgggtttaacaggacacatagtagtagacaggaagtttttcgtgatctataacacattttcatattagggtcatgttaatttcacaatgaattgcatattaggctcaattagagaaacaataaagaaggaagacgggatgacagaaagcattgaagaggaggaagcagaatggaggcagagggtggaatcaaaaataaggacaaagagaggaaggggaaagagaaagaaaatgagaagtaacgtcagcagctccgtaggttctgaggtgagttagctggtcgtaggtcaacagctttagtcacacatcctgttattcactttgggcatcagagcacattttcactaccctttgaaatttccatacagtctacagcgattttgtagcaatctttctttaccgggaaattgcttatctgcttttcttttcaatctttgaggtcaacttattaaaggctttagtttcacatgaagcccgaaatattttgaaggtaagaaaaaaatgtgcctttggtcttaaatatttccacttaaatcttgattctgggctactttaataattccaaaataagagtgagtggcttcttttttcaataactgaaatacaacatttaaaaacactcatgtaattattttgctgtgttcagttgtttgaaagtagacaaggtttgatttgacagagctgtgttttaacctgggctctacatgtcactaaactactgtcccctgtaagctcctgtttcctcgtctacagatagaggtactccagtagctctccaggctctgtgtgtctctgtcacaggtttggcataaagtagacaggaatggtgtcagttcctccctccccaaactctctccaatgacactcccaccaagtgcagaaacgtacagaaagaactcttcctgcttttcaacttccattgatcacactgaaagaaatatcacattagcttataaggctcaaaattatcttcagtgctatagctctgtgtactctaaaatcagagcaacataactttggttctggatgaaatcgaatcaggacctgactctactcctagaagaacgctgaccccaaactcctgttttgcagaaccctgaaggagcaagtaaagatgccagccattaaatatgaagaccttcagagacctagaactaatggaactaaatcaaggatttctattttatcttagattaaaatgccatttatatgcattcagggcatagttttcactcccatgaggaatagattcatacctgtataaagctgggaatataatgactaattaaatatactgtatgacttcaatatagccaagaaaattacaatcattccaagtaatactgtttttccccagacacaaatctgaggatcttgaatcttagcactggaaggaatgtagacatcacgcaggctcatcacttctctggcacagaacttgacttgccttgagcacatgtctggtagcttcttcctgggaacatagatgacataacgcatattgcctttccaggcagcttgatctgtcatgagacagctctggccttttagaaaccagcctttatactgagctgtgagcctgcttctctgtattgcacattttttgttcttaattctgaacaaaaagtttttgtgaattttcttcctggaaatggtcttcaccacttgaaacaactgtcatgcccatctgagcatatttcttaggtgaggcttcccagtttgggagacgcttctctcataaaatatttctgaattcatcagtatctctgttcctataaaacgcgtggctgtctacttcaggcaaatcctaaccaagctcaggtaacagtgaagtgattgtttgctgtgaaacagtattgtactgttgaagttaaagaggtctatgattacattgtgtttattttggattttgcattattgagtattttttactttattttctttttgtaaagcccatatcactacctataacaagcttttgataagtgaactttctaatttttcctattctatagctatgtaagggaatctttaaattttgccaggactttctagcctaatgcaacaagggaggttacattaactataataatttaaatttcattagttttttcccacatttgctgaagcaattcttctacacaatctatttcattatttctgggagttctaaatgtgtcccacaggaacacatcccccttcttggaaccactgctcttccaccagaaccagcagctctctggactccccaaggcttattaggtctcattgttacccagggagtcaagcagctatcacaaggccatgctttggctttgtagctgctccaatggatgttaaaatttctcactttgttcctgatactgtacggaattatatgcaacatctctttacttaaaagctctctgcttctcccaggatccagagattcatccctggaaaagcattcaagtgcagctgccatattccatttagaatgcctccttccttcagacagccaaggttttgttattgggctcagctctatgtgcccagctccttcttcagtacaaggagctctctccaaagaggtcactaaatcccctgcaaatagtctttaactagaccttttcaaaccttgtctcttttttttctttgaaatgacactgtaccatgaacatttttatgaaatcattaaacatgttaaacttcatcaaagccatcattttaaagtcttccatgatgtctatcttatagagatacaccatactagaatgcatttttttcatttttctattgctgagaatgttgggttttatacatagcttgttattttaagtaaatgttgtgctttaccttgttcctattatacttttaattcagcctactgttagcatctgtggatgattttctatgcttatatgtcactcaatatattagcatcattcccagcttttggctttacatatgcatttttaagatgtgtctcttaccttttaaccatcaaatcagattttagttgcttgatagacccagcttttatatttcagtttatgccacctctaaggtcgttgtagtgagatgcctatataaaagacatacaaattcaaggagtgaattaaaatctcacttgaaattttaaatgtcactgaatattaattgtggtcgctaattggtatattttctagtaatcacttcaaaagctcctcattaaaaataaatcataaaaatatagaattataagagcttttaggtatagttcaatgatctaattccatccatttatctgtccatctatccttcagcaagtcatttatcaccttccttctgtatattacagatgataataaagacatctgggacaaaaaggtaagtcacagacctacccatgtgtatgggtgatagagtagtgaatacaagtgacaaagggtgtgattccttctgtttgagaggtgaagaaagtattcccaaagcaagtgacattgaatcagcaccttaagataaaacgaagaactcagcagaaagaaagtgaatgggaagatgtggtaataggtttaaatggacatggcatgtcggcaactaaatttctgtagctccagaatattctccccagtcccctgagacgaagttacagagctgtgaatccggtagtgaaagccttggtataaggcgcataagaaatgtgcagattatctaccatgaaatagaggaagaaatcaaggttattcaagtagaggaatgacacgttttagaaagacttttgttataacgttatgggaaatggattataggctggaggcaagagataagacattgtcagtgtgacagaatattttattaataaagcacataatttatactcagatctatgtgagatgagaccaattcatgtcaacatgtccaatgtttttgaaaaaatgctaagtttttattatcgcttttgtttatttccctgtgaaatatagtaggctagccctctatttctcctggcgaaatctttagataggtggaaaaaaaaatgttgaaaaagggcatcaatgacctcttttatcttggttttatctgccttttggaagatacttgattcaaagctatgaaaaagcatctcaccaatcccgtatttcacttggttggacgatgtgtcaagagaacgcctgaggcttcctctgtccgttaacaggccagtcatgagtcacagtctgaacatgaggaaatgttcatgtactttttcatagtcatggcaatgagacttttttgtgcccaaagtactatcctcgcctaaagtccctgttaaaaaggttattttctgccacaggcaggtagcagaatgtcaagatccaattccaagtgcttcatcatcactcggatagcctcaggaagctgaggttttacagctgcctggaacccacatgcttcatgtgatgtagagcagccctgttaattagctgtttcaggattcttaatgccctatggctttggaaacacttgttagcccacagagggaggggaagagctggaagcaattggactacagcctgaatttattttaattcaattcagtaaccaccttatctttctaaatccctgtttagaatctgttgaaaattatagttgatttaagtttttctcagtgatgcatcctgagagaagagggagattacaattcaaggttttctgaagccacagaaatgtggagtgctgcagaaagagctgatcgatggaactttccagacacatgtatgcaattttctaaaggctagaaaatagatgccggggatggggagaggggaggccagttgatgtggaaaggcttgtgtagagtgcccacgagtctgcatttctgttcacctaccagaagaaacactgccagttccccccaccctcaccccccaaccattctcactgcagagagctggcactcaacaaactcataatttttctcaatacaattctcatgacataacctgaccaaccatatgaaacctaatgaagaaaacaaccattgccattggcaacaaatgcaggagttgcatcacaagtaaaccacatactttacttcacaaatttgaacattagagtaccaccggcaaaaacatggtaccatccttcggtatggatgagatatcagtttacaaaaccttcactggaaagtccataccaaaatttttaaaatgcatgcaaaagctaattgtgttgacatctttcttatcagagctattgcaaattattttgtctagaggtggttcttaaaacagccacctgtctgtccactaatcatgtacatagcatcctcttcctcatattcatcctctgaaataccaagaggtgaaagagtgtttcagtagctcaccattcttggctgttacataatgggtcagattcctttctgagtagtaggagaggtcagtgatccagatctatatatctttgtgctttttccactaatacattcttagaacctagtaggtgctcaataaacgttagctgtatgaatgagttagtgaatcaatgaatgaagtgttaatttttagaaatattatggtcagaattttactaggaaaaacatttcttataatcacaaatgaaagctaggtttactcaaaattgggaatagtaagtagtctttccatttcccataccacaggtatgcttgtattcttcttatatgcttatgaaagaagagaatgtggattaagttataaactatttgtacatgatattgtatatgtaaaaatcatgtcagttttgaggccaggatttctttgtattgagtaaaattttcctaaatatttgcccattgtattagttcattctcacattgctgataaagacatactcaagactgggtaatttataaagaaaaacaggtttaagggacttacagttccacgtgactggggaggcctcacaatcatggtggaaggcaaaaggcatgtcttacatggtggcagacatgagagaaaatgagagaaaaaccatgaaaaaggggtttccccttataaagccatcagatcttgtgagacttattcactaccatgagaacagtatggggaaaattgcccccatgattcaattatctcccaccaggtccctcccacaacacatgggaatcatgagagctacagttcaagatgagatttgggtggggacacagccaaaccacatcacccattttaaaacaggcttgatatcaatttattgctagaaaactataatttgtattttcttttacatttttaatgactgattgtacatttgttccctcaaaagaggctctccaaaatactgcctaattcctatgttaatagcaacccaaacatgttttcaatactaatattaaaacaaattagcttaacaaatacaaaaggtaatgcctggtttatacaatacggatttgagaaatgcaggtttcaacctgttccacaccatgcccttcattatattcttctgccagagattttattctttacttttcattcaatcagaaagaattgagaggaatttgaacccattctgcctatttagaatatcatttgtactgactttaatcttttgctcctaatccatgaattcctgaggtcttttatttacatccataaatttgaaaagcacaatcccctttttttttttaaaaaaaaaaaaaggaagttacttttgggaatcagagacatgtacctctttgttctcttggagagctgtgggttatgggagggaactcctcatcctgtttcctgatatgcagtgacttctctcttacacagatgagtcctaaaacctttgtgagctcagacaagttggctggttttatttttatttttttatttttgagattgtctcactctgtcactcaggatggagtgcagtggcccaattaccaactcactgcagccttgaccttccaggctgaaaccatcttcccacctcagcctcccaaatagctaagaccacaggtgcacaccaccatacccactaattttttgtagagatagggtttcgccatattgcccaggctggtcttgaactcctggtctcaaccaattcacctgccttggcctcccaaagtgctggggttacaggtgtgagccaccatgcctggccaagttgcctggttctttacatggaatgttctttacatggaatgttccaggatcaattaaacacagataaataacaacttatgttttgtaaataaacacatctgaatggaatcttactccaatttagatagaaattgatatttttcctttcaaatgaaataaatgttttagactaggacatcccaagtgaattgaagattggtacaggagcctgaggaaggaagtttaagagagtgaaagcatgagagaagagccaagattatgtagcccagagaaggaaagaattattacctaccattactttaagggactgtgcttcctcacagtagtggaagacagatgctcattttttattcaagactgtgtaaaataaatggccttaatttatagatgtggatgctggtttatatcaatacacctcaacctgggatggctccaaatcttgactacacatgggaataacttgaggagttttacaaaaaaactgatgcctgggtcacaccctgagagattcttatttatctggtctggggtggtgtggcccaggcactgaaatttataaaattctccgggtgattctaatatgcagccaaggttaagaatgcagctgtacagctgtagatggaagaataccaaaaccaggccttctgctagtgcctgagcttctcctcattttagtttctgtgatgtgttcagacattgtttctagaatctcctgggtaatatgagttatagtcctttggatggagtaatacattaacacatccatactcacatagtttggaaggggccaggatgcaaagggaagttggaggaggaagagaaggaaatggtaaagtccaaagcatgggtgaaggggggccaatataaacccacagagcaaaaaggagatgttgggtcatcatattctattacataaattggatttacatttccttgtctttcattgctggtctttattcccacaagtctccaaatacagtcataaaattctcatgagttgttatagcaaaattgcttatcatttactatttcttaaatgaatgcataaactgtattactttggcagaaaggatgctgctgggtatcatatgtaatgtatactagtaaggtggacaggaccattaggactttaaattcctttataatctcaaaagtctgtgattctgatcttcctggtcttgcaactccagaaaaggtggtaatcactggagtaggctatttatgggcctgtgagatagtgaaacatgctattaagacaaaatgagagacttccttctctgaaatggttccatataaaagtaatatatggcttaagtatccaggggctcatgtaatctctccatgtcagtatcttttacggggaattatttaaccaaacatgtattgaacacttacgtgctacactaaaatcccagatttgtcaagttcccgtttaaaaagtgggtactaagcctaagatattagcaatacttgtatctgaaaaggcctcacatctagaaactataaagaacttctaaaaatcaatcaaaacaacatagttcttagaaaatcacaaaggaacaggtttttcagactcgaggatgtctatatggtgaaaaagcagcagtattttagagttggtctgaactgactcacaggaacctatttttaaatgtccagaaatttgctaagcaaattgttaatgcatcaattatctaaagtttaattatgtaaacttcaagttatctgaaaaacataacacatactcaaaactctcatcccttcctaagtgttttactacattctgttatttctgtttgtgaggtcatttgtttattgcatctgtatgatggaaacactgtataaaatgacatgttattcccaactccacataggctgatataacgttggtagcttaaaatcagctttagtccaggtatttatacaatggaaatggaaatcagcatacgccacaaatcaggagttgatttttttttttttttttttttttttttttttgagatggagtgtcgctctgtcgcccaggctggagtgcagtggtgcgatctcggctcactgcaacctccgcctcctggattcaagcgattctctgcctcggcctcctgagtagctgggattacagttgcccgccaccatgcctggctaatatttgcatttttagtagagatgaggtttcatcatcttggccaggctggttttgaattcctgacctcgtaatccacctgccttggcctcccaaagtgctgggattacaagcatgagccactgcgctcggcccaggaattgattttttgtttaatggtgttgactgtctacaaactgattaagaaaatgttattaaagttgtacatcatgtctgcaaccattaaattgtaagtagcacaaaaaatctgggggaaacagtcttctagactttccagatgcagcaaagaaattgccttgttccaacatacatttttattgtttcacttttgtcttacttaaccactaagtaagacatagttcctacataaaccaatcatgtaggaattacactcctttttcaattacaactttggtttgattacctttgtggtcttctgttctatcaccgtctttttttttttttttttttttgagaaggagtttaactcttgtcacccaggctggagtgcagtggtgtgacctccgctcaccataacctctgcctcccaggttcaagcgattctcctgcctcagcatcctgagtagctgggattacaggcacctgccagcacatgtggctaattttgcatttttagtagagacagggtttcaccacgttagtcaggctggtctcgaactcctgacctcaggtgatccaccctcctcagcctcccaaagtgctgggattacaggcatgagccactgcgctcagctcaccatcgcttttagataaggaaactgagccctagagagtggttggctcgcctcaggctccaggacaaatatgacttaatcaaaactatactcctgttctttcattcacataaaactacttatctaaggatgctgcagcaacactgctgtcaggccagaattcagtaagtttacagctgaggccttatctatagaccattgattttgctcaaggaaaaagttacacaaactagcaatagagtcctgaccaggcattacaaattctacactgatgtgtaaaagagggactaggcacaaagaatacatgcttagcacaatctatctttattataggaaaagcaatttaaaacatattttactgagtagtgccagaaaattaccgaaaaagaaagttaatgctttttccttctcaaaacccttctataatgtgtaggcattgtcatattagagagactcctgggaaatgcttggtcaactaaaattgttaaagagctaaaattgaacattgactcagaagcaatgtgaaatacatcttcccatttccaggatggagtgcagtggtgagatctcagctcactgcaacttctgcctcctgggttcaagcaattctcctgcctcagcctcctgagtagctaggattacaggtgcctgccaccatgcccagctaattttttaatatttttagtagagacggggtttcgccatgttggccaggctggtcttgaactcctgacctcaggtaatcgacctgccttggcctcccaaagtgctgggattacaggcgtgagccaccgcgcccggctcactgacgctcttcttaatttcttctgcctaagaaatagaaggtattctcgagggaaaaaaggcattgacaactagtacagggaaattgatgacaacataaggctgtttgaggaaaaaacgtgggatctcaaagactgttggtgggagtgtaaattgaataatctactttggagaacaatttggcagtttctattaaaatttaaaaatgctgatatcttatcagttaatcctacttctaagtatctattattaaaaaaaatacttggcatgtattcccaatgcgttttgcaagaatgttctttgtaattgtcaaaaggtggaaatctgaatgccctccagtagggaaatggctaaatgaaatatgaaataaccatactattgaatactatgcatcagctaaaaatagcaagagatctttgttgagtgaaaaaataaattgctgattgatcattaaatataacactatgtttttaagaagcctcagaaaacagtaatatatgatcctataggcataaaattatttatgatatcacacggaggtctatagaatttattgtcctctatggtagccactagccacatgatgctatttaagtttaaattaataaaattaaataaaaataaaaatttcatgtctcatttctacgagcctcatttcacgtcctaatagcaacatttgaatggtggccagtgtaatggagagtgcagatctagaagaacaaacacaactggtaacagagttacctgggggaaggttgagtttggggatggagggctacagaaactttagagttctgcagaacttttaacatttttacaatgagaatacatcatatattatctagctaatttaaaacaaatacattgttaaaatgaaaagcatgcctagccaaaggatttctttcttttttttttttccgagacagagtcttgctctgttgcccaggctggagtgcagcggtgcaatctcggctcactgcaacctccgcctcctaggtccaagagattctcatgcctcagcctcccaaatagctgggattacagcatgtgccaccatgcccagctaatttttgtattttaatagaaacggttttcattgtgttggccagtttggtctcaaattcctgacctcaggtgattggcccaacttggcctcccaaagtgctgggattacaagtgtgagccactgcactggcctagcaaaaggatttctaaaacaatgtagaattttagtagatagatcagtataaattgatttgaacaccctacctttttagcctgttaactatctaaaagcataaaaaatagtaaaacaaacggcaaaatcatttcctccttccttttctacctgtgtctagtgtctattgaacacttactatattcccagcatttaaagtacaagaatcatgaggcaactgctgtttagactgaagtgttttcaccaggggtgtatcaagaggatttctttgtcataggttgatttcccttataactgattgattaaataattactagttggcttatgcaatgtttatataattacaggatataaatggtggttattagcctaactagaatatatgcctttataatattggtgtaatattcatatgtattttactacagcttaaaataataatttcagaaagaaattcaaattgattttcataatttagcaaccatttgagctcttccaggtcagaataacttcttgggaagccccagaaagaaaagcatatacctgcttttacagttatccatagattgactataaggctaggtattgagttggcggatgcatactttcttaattctttagataataggtcaatagtgtggtagtgaatcttgatggtaagtgtccttcgcatgtttcatactgcacagtagactagactgaaagtcccaggagactgtgagtgtagcaaagaatgaatcttgtatccccagatacacaaagaccatgtcttcactggacccacagaacctagcacatggtgtgtcttattaaatgcttgtagaataattaaataaattacattcagaaaacagtctataagtcttaaagtttacctttcaattatgtaattattacttttaatttataatttattaacagacatagatattcacaacacctgcaaaagagtttatttcaacttcttttttttgtctcatctaaaaagtgtggatttaatatagcaaagtttgcttctagaatggaatcttttagagtgtatatgcgcttttgaaaaaaatggtttatgattttgttatgtaatactgttatataagttattttagaaattgcatgatttattataatatcagcagtgaatttaaacattacacaaatgcctgaatataaagaaataggatcacctgtgtccaagttaattgccttcttttgctgtattcattagccatcaatacctacataatctaaggccaagatacatatggagcaatctatggacaggcaatagcatcccatgggagctttggaaattcaggagctcgagcctcaccccagatgtactgaatcagaatctttatgttagcatggtctccaggtgatttgtaggtccatcaatgtttgaagagcacctgtctggccttcagttgcctttatacatcttcttaccaacagtaccatctagtccaatatttttctgtcctgttagtttgtccatagtctcccaacaggcttctgtccacaaagctgttatttagaggcatggccccatccctctcatagtctttgctaaggttatgtcttttacatttggagatacaccaattgcagaggagggtgaaattagcctgagagcaggaccataacaataacctgattctaatggaggctgttaccagggcagccagtacccgaactaagtcatcattctgctggaagcattccgtttggctgcagttcaacaaaaagaaaaaagaacgcactccagaaaatcaggaaggtttgcattatctatcagctatgttcaaggagatgtttgtggaaagtcgagttaagggttcctggaaacattaatctctggacatgctggaggatgcaggtggatttagagccaggcgagtctacattcacaaatcacattaacatattaaaagacggagagctcttactctgaggagccccatttagttgtattcaacccagctccatatattttttaaatcacaaaatgcttttttttttttcgtgaaacattcattaaaattaggcaaaactcatcttcggtgagacatgctttgtgaaatgtgagtggagaggttcctctgaaattgtctaaaaggtaacttaagccctgatgttttagaaaatttgacttattatgtaacagtgaatatacctatctgtgtagtttcactattttagaagtaaaacaatgctttgatttcaaatattaaattaacttaggcattgctctcccactccatctcccaagctgtgactcagatatcagaacaaattttttacctagttagggaaaaaagtttcccaagtttcagagccataaaagcatcagtaaagcacctatttattgtagcactctcttgttttccatcttcaatttcctaaacattgaatatcttgtttttcatttttcttctaaaagcatttgtggtatataataacaccgcatgaaagtggaagagactatattggctcaggatgcacttgatatttgttttccttaaatgacaaatgaaactcccaattcaacactaggataagattttttttaagttattaaaccttagttaagttatatgacttcatactgggaaagtgagttccagagaagtttaatgaacttgttgaaggtgactttgctaacttattacaaaatggggaatacaactctggtttccctaatgccttttgtaaagcatcccagataaaaatctaggtttcagaagattccttatagttaggtatgaaaaaatgttatttctgaaaatatgatttccttatgagaaaccattgtttagatatgtttaactttagaaaaaatttccaactataattaaaatctatgaattatagacatgttcagtgaaatacactgtctcatagaaaccatattcaaaaaacagaatgactggaacagatgttatgtatggggattagagggaagttatccagttatattatactaatttgagaaagattccaaaaaaatcctttcttgggggccggtcaggggtgggtatagcaaatgaaagagaaagataaggaaatgtgttccttggtgttgagttttgaatagatcactattgtgttatattcctctgaatttaggatacctgttggattttgttccttatcatgtctgttatgtggacaaagacaacaaacgtttgtttcttcttgtcaatttcattatgcacaaggattctgaaggtccacccaagatctttcgtgcactaaatgtctggtgtttgtaatacaatgaacaattttggggagtttgaaaatcttttgattatgaccttgaggattagagatcatttggtgtggatgacttcgaggaagttatttaattttttttttgtatgtcagttttctcagatttaaaatgtgggtaatagtaaccaccttgttagaatgattgtaatgatcaaaacatgtaataatgcaaagtgcttatgcttagtgcactagtgttttgcacttacatctagttatttttttctcagtaattcaataggctaagggatgatctagtacagattgagatatgggatttttgttgttgttgttgttgacaagttgcagacaaaatgtttggttattcctctcactgaaataaaacccagaaatatagggtattataatatgttaaacatttagtggctatcaaaacttattttcttctttgaagtcagagtaatatttagagagggcattctggggtttccttttagcaaaataattagaagtaatttcccttagaatttttagaatgactatattaggaggaaagggaaggttcttacctaaattgtattgcaacttttctctgaaataaaataaacatgctgtgttaaaattgctggtataggccaggcacagtggctcatacctgtaatcccagcactttggtaggccgaggtgggaggatcacttgaggtcaggagtttgagacaagtctgaccaatgtggtgaaaccctgtctctactaaaaacacgaaaattagcccggcatggtggttggtgcctgtaatcccagctactcactactcaggaggctgaggcaggagaatcacttgaacccagaaggtggaggttgcagtgagctgagatggcaccactgcactccagcctggacaacaaagccggactgtgtctcagaaaaaaaaaaaaaagaaaaaagaaaaaaaaaatgccattgtaagttgtgccctataaaatgttaacgtttctttcaagtgaaataatgacttactatttcagcagagatcactctaacatttagttttaatctaggaaaaaaaccccatataactagatttggtctttttattaaaatgaattgatcttagaagagcacatcatatgctcaaaatatagctgtcatgtaaatcaagacatatatttgttttgttcaatgaaatctagaaactcttaaaaaaactgtttactggcttttgatgtttaattgggtggaatgtataagaaatatctgatgaatttttgacttctctattgacttccaagcttatatacagccaatgaacaaacttttctaagtcttgtactctctttccatttctacacaaattcatattgaataggaaatattgaaataagatctttagaatcctcctcttgcaaattatagaacatattaaaaccaggttaaacttatttaaatctctttatatattgtttacccacctaccacgtaaatgttactgatttttccatagtaaaaagtctaaaaatccaatgcatcttacctcccctaaactacctatctctccaaacctctcattattcctccatatgtaccttctttcaagacttaattcaagccctgccttgtttttgagttattctctgtctagataaattattggtcactccttttaacccagaaggcaccaatcatttctattattaatttgattcttagtatttattttctttgttgggagttttatttatattcccttctaaagtagatattttacttttttggaaatctctgcctactagcccagtacctaataaaaggtcaatgatgatgatgatttgaaaaaccatgttctacagtgttcagatgtgcttttagataaggggatgatataactttatcatcaaactttataatgaaaaataatcatgatgaaaatttaagataaaataattttagaatatattatttggctaagtggaaaactatcatggagtttaattaaaatttcttcatattgaaagaagacaggtatatagaggagaaaaaaacataaaaacaaaaaacatctcaggaattccaccttcagctgcccttacttcaataccatgcctcagaaagaacttcatgacttggcaggtttacaggttgactcagtgtatatgctgagaatagccaagggcaaaatttagtgttaactagatcaagaactcaggggacccaggtgtctactgttttccatagaaataaccataaacaattttaaatactagatctgctttccttttgggtttgtataatgtagagtcaaaatagaggctctggcacctcatagacacagatttaaatcccatttatgccattggtaaactatatgacctctggcaagttatttaacctccttatgccctcatctctaaaattgtagtacgaaagcaacaccctaagtatgattgcaaggattaagggaaataaaatgcaaagttcctggtacataattgatatctactaagtgtgaatttctctaagttcctcatatcacataatggtagatttttatttactgggtggttattctgtaccaggcactctcctaaacacttatatcatggggattaacacatttaatccttgtagcattcttttgcaatagctactatcatcatcatcctcattattatcgtcctatttcacagatctggaactgagccactgaaaagtaaagtaacacaactagtaactagtacttctggggttcaaaataaacttttcatttctaaaattaacccataccttcttatccagtagacaacataacctctcccactatcaggtcatttccatggcctatatcctgtggacaatttgaaagcgatttccttttaacccttgtttatctaattagaacatagtttggagaaacatacaatgttttccatagctgagtataaatcatttcttccatccttttgaattagccacatcattgctctctttccattgtgggaaatctagccttgcttgtttgtacctagacaaaagcacactttttgtgtcagaacctgtgaaaatctcatcttccttgttaccacctataaatgattaatgagacaaaacattttcaaggattccaaataatctaaaaaatcccacaaattttgaaaatccacaaagaggtatctaggaaaactttcatgaagttaagagatgttatctgctgttctaggcgtgggtgactttatcaaaacatttcgcccactttcaaatttccacttgttaaaacctgaggccttatttggctgtcacttactgtacagtgtttttcagacaagttcctggcagctaattttaaagagattttgtgaaaaacacaagctgtggagtgctcctgttggaagagcaccctctgaccctctgccttaacataagaaaaaattgccagtctgtccaaacctcacccacctttggttatcttcagaatcttacaatttgtgtttcctaaggcagcaattttcaagcatgactttgaaacactgcaggctttttcaagttatttcaaggactggccaagaattctcaaaacaaaattaattttgtatttttaaaaagcagtatgcatatcatgtatcatttggcagatttaggaggttaacagtaagcattaggaaattgaatcaataataataatgggatatggggacctgtaaagaaactctcaatcctgcttcattacttttaatggcaaaaactgtaattacttttgcaccaaccaaatacactgaaatcctttaacatacaccaaagcaatgggagatctgcagaatgcttttgtccatgtttaaccataatgatcaatgcattttgaatagaatattgttatatctactatttagcttaattgtgatcattaacaaagtgcccagactctctgaacattctacatggcatactatttgtgagaagatcagcatgtaaatagtttactctttgtaagctcttctacaaggtggctaaaagcaagaactagaacccagagtcccttgcattcaatgaatttccctattattgcccatatcattctttcttttctttctttctttctttctttctttctttctttctttctttctttctttcttctctctctctctctctttctttctttctttctttctttctttctttctttctttctttctttctttttctttttctttctttccttctttttgagatggagtctcgctctgtcgcccatatcatttttagtataatctcttcctttacttggtcactaagaatcacttttctctacttagagccagacatttaaatatctccagcctccaagatctcgtctgggtacttgggctgcactttttcatgtcaatcattttgcacttgtcatctatcctattaggctataagctccccaagggcagatatagagacatagtatcaagctaacctttttatttatttatttatttatttatttatttattttgaggctgggtctcgctctgtcatgcagtctggagtgcagtggcatgatcatggctcaatgctgcctcaacctcccaggctcaagcaatcctcccatctcagcctcctgagtagcctgggactgcagacgcatgccaccacactcagctattttttaatgttttatagagacggggtcttgctatgttacccaggctagtcttgaattcctgagctcaagtgatcttcctgcattggcctcccaaagtgatgagattacaggtgtgagccaccacacctggccaagctaatctttaaatatcctagagcacccattatagtgtctggcaaaaaataaatgcccataaatgtttgttgaatggaactgagtcttcagaaactagagattttttctaaaatatttttttttgccatttcagtttaatacatattagtttttctcacttatcctatcatctgaattttttatttctttgaacctgaacaggctttgtgtctacagactgctgagcctttaattttgttgtcgtttgttttgttttgttttgcacaaaactaaaaacatgtacaaatacatttttaattgcatttgttcattctagtttttactcgtaaagtgcacttctttcttttctttctttccattaatttctgaaccttcccttcttaaactttacccagagttttctcatcatatacgcatttcattttcattgtacttttctgcatctgactatttcattttccagttgttctggtatgtttttctaagtattgtccaatcctttccattaagttacaagctccttgagggcaagcattgcacacctgttttgcacaacttctaaggccgttcagtccctcagcccactgtatagaaatatagtatatatatagacaatacacacacacatgcacacacataccttgccacttaatgatgtaaagtgacaaaaacttttatattggtaaaaattatgagaataagaataatcatatcctgattcttcaaattcaaatatttgtctaacattttttgatgaagtcatagcacttatgtgtcattgaattgttgtgggcatgctaacaggaaagatggaccaagtggttgaccctgtccttctgtgaatagaacctcagagtacacttttctgtaaacatttaaaagacaaggaattggaacttaaaatggagcaaccaggggggcagggaaacagaataaacttttaaaattgacctaatagtaatcataggaaacaaaaagaatcattccagtctccatttttttttttctggatgcattttgtagctccctaagttattgggtttttaagaaacataaaatattcctagatcgttagagatgtgatttgatttcaatcccacatggtctgtagcatcactaagctactgggaacttccctatgcaaaggtttgagtttctttccaatgctgtttaatgtctgcacttctagtgtccacataaatgagatttaacaggctttacttcatactttcttgttacaacatttttactttttttccaattgcaaaattatttcttttaagctctctgaataagtttgttgaagctctattcatcacacataaaaatcttacattaaaaggcaataaaggaaatcacgaaaagctagatgtattccaccctcttatagttgaatacataaaattgtatatatcacaaatagtaattgaaactactcttatgaaaactatctgtccttctggaggggcattagtttaaatgcaaagagaaaacatatcatttgtgagtctaaatagtgttgttagttctttgaaagggccctaattaataaggttgtagaacacaactgcaacctgtaaagcgttccatgtgtagtattttgaaaccttttgtttgtttgggttctaactagagacagagggagaaaaagtcaatttcattctcatgggatttgtcttatgtggttcatcagattgagtttagtaagcagggaagtatttctccttgtgtagctagtgcttgtttattcttcccttattaaaaaaaaaagagagaaaaaaacaaaggattggcatttttcttttatgaacgtggactgtagggagataaatagccctgcgggagaggaaggtcaagttcaaagtttttctttcctttggattcaggaataagcaaatggaaagactagccaaacaacccagcagcaggcatctgatggttaagccctccccccaggactttttatgtacataagcagcagaagtcactcgcgcagctgcggcgcattagttccaatagtttaacaggctgctttgtagcacggacaaagccgtgcgagcgcggtgctttccctccttgttcatttgctatgcgagcttgtcagtgatctttggcaggggcttgggagaggaggggtgacgtttaatacgcttccgcggaggagtgcgctcgcctcctctgcacccagccccaggctctacagagagactgaggcaggcgactgaatgcactaacagcagcaggctcagacctgcttccctggacatttccgggaccgtgagcgagggaaccacgttgccctggattcttgccagctgtacaaagttgaccaggaaaatggctcagcagacaagcccggacactttaacagtacctgaagtggataatccgcattgtccaaacccgtggctgaacgaagaccttgtgaaatccttgcgagaaaacctgttgcagcatgagaagtccaagacagcgaggaaatcggtttctcccaagctctctccagtgatctctccgagaaattcccccaggcttctgcgcagaatgcttctcagcagcaacatccccaaacagcggcgtttcacggtggcacatacatggtaaggtttgcgcagacctcgcagaaatggtggccgtttcccttcagggagtcctgctctcgcgcctttaattttgggggtagggagggaggaccatcatcattcctcaccggggatttatggccaagtgatctcccttaaccataaatcccacaaatgtccaagtcagggcaagaatcctggagactggtactaggagtggttgaggtgggtggttctcaaagttcaattcctattgcaagttcctacaagaaaattggatgccagatgtcaaataagaatgcagttttattcccatacgtacgtagtggcgtttctttgattccttaaaccaatttccctgccagcttccccaacagctgaggaaagaaaggaccagaaatgaggggaggaaaatcatagtttgctctgttttctgcatgatccccacttggacagagacacatacagtgtgtgtgtaatggtggtgtgtcttcataaagcccttcctcactcctgactttgatatacagtattcataatcttaaacatgcctttccaaaggaaagaagaaagggattaggaattctacgcagaaagttgcaggctggtacttggtagtattgttgtgttctttgaatttggattgttagaacattttgccaatctttttattttctttgtgaatatttttatcttctttataatgggtgaatttgtttcatgcatatgcttccatgtatttttctggaggattcctcatcttttcctgctcttggaaaaaaaaaaaagaagaaaaacccaaatattaaaacagaccatcatgtgagcttatttggagtatttggagtttctgcctgagtagaggccattccaaactctgatcagtgagtccaagtactagggtctatgttacacacttagataatttcaggtagtagtaggttctatacattacatctacattttgataagatgagtataaattatgataaagaaaacataacaaaaaagaatgagtgtgttagttgagaaactgtatgactaaataattttttacagttttgccataactaactaaacagtatgtacgttagcaatgggagggaaaaaaaaagcagaaacaaggcttttaggaggaaagcagcaaaaagtaaaaggaattaaaacctaaaccagtgacaagaccgtgctcaggaatgcattgatgttatagatgaaagtcaatgacaaaggaaataaaagccatgtcacacccaaagacatgaccaacctcaaaaatttggttttaagtagctagatctctgactgggaaagtgttattgtccccaggattttaacacctagatggcatttctgagtttggtagatgtaatggccataagaggagtgagacaaacattgactttttctgtcttaaagcagttattgggaaatgatggcttctctttgaggaagattttctttttggaaaaaattgtgagcaacaaacagtgaataaaagaaaggcatgaataaacactgggagatgcactgaaggagaaggttggctcaaggccaggcatcgggtgccagagcaggagagctggcatgagttcctacggagccaggaccagaatttccgtgtccagtgtcccttttggttgcgctgctttatcactgcagttcctaaattgcacccattgctgaatgagtggccctcaactcagctgtttgatttcagtctgagtggagcaacctagagttcagctggaggttatctgaactatttagacatgtcgggatgtaaggaaggcaggaaatcccatgaaaataggctttcttctgacatttctggcacttccttttctggtgctgtttggaaaaacttcatgagcacaatttctatcaatatttcattttagtgtatcaggtcacagcccagtaagaaaagcataaagagagcaatggaaaccagaaataaaaatcatggtatcgattttcagtaactcagaaggaagcagtttcccctatggactaaaactatcaggcaagggagttggaaagagtatctcaagttttccatattggttgaatgagccccaagacgttcataatatccacaggcatcttttgacaaaaatctcatttgtgctttcacagtttgtgctaagcactatggagaattttgaaaatatgtttcaaattgttctgacataaatataaatatatttgtatctaatttgttgctagtacagtgttctgcctcacagtttcctgctcctggtattcccctccattcgctatgcatacacttaatacctactgagtctaacatgtttattctgtacctaattattacaaagttgagcaagaaccatttgttggtttccaataatttataccatggtagaataaatcaataatattggaagacatctgttttagctaagataatcttgctgttctacaaaatagtctccaaatctcattggattgacacagtgaatttttatttcttgcttctgctttttgtggggaggcagcctgccctagccactgggtgcctcagggacctggaattctaccatcctgtggttccattatttgcaacatgtgattcccaaggttgccaggctcagatgaatcaggagaaagaccatgaaagaggatggtatgtgtgaacttttatgagacaggccgggaagtgcacatgtcacttatactcgttttcttctggctggaactcagttctatggccacatctaactgcaaaggaggctgggaaacatagctctgttccaaggcataaggtaaagtgctggtggctaatctatcttggttatatagtatgttaagggctatctgatttaccctctatgccatggttgaattcttagaataacatctgtaataacatatgccattgttgaattcttagaataacatctgtaataacaagtccttgaacctctcgtcaaacctccttgatgaagattatacagaagcacttctgttgtttgatagggctgttgattggaaagaccttgcttctaaacagtagaagtctccttccctgcaactatcatccatggatccaagatctgctttgggaatcctacaacttgaatttttgctcccttccattatgaagccctaaggcaagtggcttggagtaacccaccagagaaccagggccctattcattcattttggtatacccatgcttggcatgatggctggtcaatggtggaagcttaataaatgtctgctaaacaaattcattaatcaatattttagtgttctcatgctcttaaaaaagacttctcttgggctaagcatggtggctcatgcctataatcctagcactttgggaggctgaggagggcggagtccctgagctcaggagtttgagaccagcctgggcaacatggcgaaacaccgtctctactaaaaatacaaaaaattagccaggcatggtgatgtgtgcctgtaatcccagctccacaggaggctgaggcacgagaatcacttgaactcaggaggcggaggttgcagtgagccatgattgtgccactgcactccagcctgggtgacagagcaagactctgtcaccaaaaaaaaaaaaaaaaaaaaagggacttctcttttcttaagtaaacatcctgttatttcatttctatatgctatatttaccaggtagtttttatctagacttctcttgggttttcatgatccatttaaagaatagctactgaattgacagcatactctaggtgctatgtcactcagcaccaaagcagttagaaaagagactaaacttaaattcttactttgcatttagtaattgtgtgactttggtcaagttacttaacgtgtgcttcagtttccccgttagtcagttttctgggaatagtatctattgggggttgtggtttaattaagtacaattatgtataaattaagtggtttcacagggctggacccttagtgggtgtcattataagctagtattttttttattatgtactctgtgcccattattccagccttggtctgcatgaacctttaggatcatgtttaaatttctagatgattactctgtcagtcatttgtggatgaattagagtgaagagacaagagttgaaagaaacgagtgtatgtcagttttattactgtaggaaaggagaaggcagaaatgagagatactactgaggcagaactgtggggtttggtgtctcttctctgcccactgcaaaaatacatctttcaaattcctggttttcctaaaaggttcctccagttctcccaactggaagtaatccgttccttccttcaaggaacagatttctattgcgcctcttgtctctgatactctcaatgcttattagtaatagttttatcactagctagtatgtgttgagcactggttttggtctggcaccatctgttaggattagaattctcttgtgtctctgcttttcactaatctgtttgactgcttttactaaacatgcaatgccttgtagttctagtgattatagacatgattcagatttcatctggtaggggattccctctatcatcagcaggaactacaaagtcaatggaatctctggtgaagaaaacttaacttccagtactagtttatttcaggaaaattgaaatcaggaagttcttcacattcttcaggcttttctcgtcattgaattttaagcacagttttggggtgtaaggcctaaataagttttagaagaacaaggtagaaatgctggttttcagtctttgggaacttaaaagttgctgtttagtcatatttaagtcataaaacctgttatcttcacatattcttttaaaaagtaatttagcattataatcacttaagttataattttttcatatttttataatacacatctatatatccacgactcagatttttttttattttttattttattattattatactttaagttttagggtacatgtgcacaatgtgcaggttagttacatatgtatacatgtgccatgctggtgtgctgcacccattaactcgtcatttagcattaggtatatctcctaaagctatccctacccgctcccctgaccccagactcagatttttaaaatgccaaaattttgtcattgtttgcatcagttcttttatttttttaagaataaaatgttacagataatgtctaaagctgtcacccatcctattcttcttccttcgcagaggatcctgaaatcagtgtgttcttccttgaatgtcattgtcttttaacttcatatgtatgtgtcctgtttgtgtgtttaccattttatatatagagatggtacatgtatatatatctccataatatgccatactataaaatgagaaagagcaagctatatatatatatatatatatatatatatatatatatatccttaagcagtttgctcttttttagtacgtagtataggaatagagttgtgaatatatatataaaatatgtgtgtgtatatatacatatatatgcatatatgtacctatatacatatattatatatacctatatgaacctatatacatatatacacatatatgaacctatatacacatatacacatacgtacctatatacacatatacacatatgtgtacccatatacacatatacacatatgtacctatatacacatatacacatatgtgtacccatatacacatatacacatatgtgtacccatatacacatatacacatgtgtacccatatacacatatacacatatgtgtacccatatacacatatacacatatgtgtacccatatacacatatacacatatgtgtacccatatacacatatacacatgtgtacccatatacacatatacacatgtgtacccatatacacatatacacatgtgtacccatatacacatatatgcatatgtgtacccatatacgcatatgtgtacccatatacgcatatgtgtacccatatacgcatatgtgtacccatatacacatatacgcatatgtgtacccatatacacatatacgcatatgtgtacccatatacacatatacgcatatgtgtacccatatacatatatatacctgtgtacctatatatacacacacacacatatatatatctatatacctacatatatatacacacatatatatatacctggatcattttttaaaatgctcaacagtacacacatgtaacagcatttcagtcaatggtggactgcatatttgatggtggtcccataatattataacggaccagaaaaattccaatcacctagtgaagtcatagcacaatgcattaattactcttgtgtttgtgggcatgctggtgtaaacaaacctaccatgctgtcagtcccataaacatatagcatatatagttatatattatacttaataataactatgttgctggtttatgtatttatgtattttaccattgttttaaagagtactcctcctacttatatacaaaagttaactataaaacagcctcaggtaggtccctcaggaggtatctagaagagggcattgttctcataggagatgacagctccatgcatgttattgccccagaagagcttccagtgggacaagatatggaggaggaagataatgatactgatgatcctgtccttgtgtaagcctaggctaatgtgtgtttgtgtcttagtttctaacaaaaatatttagaaagtaaaaaaaaattaaaaataaaagcttatagaataaagatatagagaaaatatttttgtgcagctgtataatgttagtgtttcaagttaagtgttattacaaaagagccaaaaaattaaaagaaaattaagagttgtataaagtaaaaagttacagtaaccaaaattaacttatatcaaagaaataaaaatatttataaattaagtgtagcctaagtgtacagtgtttataaagtctatagtagtgtgtggaaatgtcccaggccttcacattgactcaccactcactcactgagtcacccagagcaactttcagtcctgtaagctgcattcgtggtcagtgccccatacaggtatatcattttttatcttttatactgtatttttaactgtaccttttctatgtttagatatacaaatacttaaccattgtgttatgattgcccacaatagtcagtagaataacatgctgtacaggtttgtaggctaggagcaataggctataccatctaggtttgtgtaagtacactctaacatgtctgcacaatgatgaaattgcctaatgacacatttctcagaacttagaataagcaatgcacaactctgtgtcaatttgcctctaaaaacccagctgtttatactcttaaaatattgttactatagctgtcagtatcacactccaatctaagtgaatgtcacaatgaaaaacattgagtcattttactataacggaaatgaagatgtaatttcctgaatttaacagtcaatttaggctacatagtgaaatattttcaagctactttgaaaacattaaccattaaaaactaatattcatgggtagcattcactaagatgcatcaggtttgttatttatgatatatctctcaaaaacatttttaattccaaatataattaaaaccaaatacagttttctaatataagtaatttcatggggattatattcctgattaaggactagatgaaaacattgtcaatttatactgtgctcgatgcactgaatggaggaaaatgttccagcgtgtatataagcgaaattaggtagtaggatatctttaggaatcatggtgactaggtaatactcaactgtataatttttataattcttgtatacacatatgtatttttaattaaaacatatccaacagtagaagaagtacttagtaacaatcttaacaacaaaataatttctttaggtggactttcaaaaggccttttaggagacttttaataaatcttaaatgtgtttaggaagctaaataagtgattttggccatattttttgtttactataaatttctctttatcaggcattggcattagatgtaaagttgctcatatttaaaagtaaacatttgctttctgagtcattatttcttcagcaactgtagttgtttttatggttgttaagagaaatataaatttgcaagtcatagaaggggaaagaaaccatttgtcacctataaaagagaaatacagccacttagagtttgtagagtaaaaatacacatatacacacacaaacaactgagtagattttcaaagccattatttagtgatttctctttgaggtctctttctccctcgttccatctctcttacttctgccctgcttagctttaaggttatcttttctctgtctcttatggtaataatacccggagaagagcattgctgccagtctcctgggaactaggaacccagaggagggctgtaggcaaagtgtaataccagaaggtggggagcaagtttctgggggaaatcatctgagaagcacaccaggaagtgctgctggaatgtttggggaagaccagtcagccctaaccttcagccatgtctgtggcataactggctgttgccctctgtggaaatcatgggaggtggaggcgctgcaagttgagggtgtctgtaccatttgaaaggcatagttggctttccacgaaatcaaaagacctgaggaagattttccttttaaagaacatgccgattggcttgtcatgtttaaggaattacagggattacattatgacaattggcattgagaaaaaagtgaagaaaaccttggataaccttgcagcttattattcacgtgtgcttcccatgaccattgacatttatcttaaagagaaaagatgtgaagcctgttcgtacgagctgaagccgttgctactgatggtaaaatctcttcttaagaagacatggtctttcttgcaaacttggcagaaatgttgataagaagaaaataaaaacttgaatcttaaagttcattaaaataatgaaaatcatggctttgattttttaaaaaatattctttgtgtaaatttctttataattgaaaagctcctatgtattcagataactaaaggagtttcagcactttttttttcttagatagaaagctaccaaatttgttcttcaagtagcactttcaggaagaagctttactatctctaatgtagcaaaataatgtcttttttttaatggttttgctttttaaaaaatcatgtttttaaagctgcgattcattcagtatattgaaatcacatatttccaggtcttctggtcatttgatacttgaccttagttattcaacctttttgacttggagactctattaataagtcatatggttataaaggcatttggcatttacaagtaaaaagtaatgactaattaaatttacaaagtgataacaaactacagtctatttaagattagcaattagaaacaagttccaacttgctgctgtaagaaagtaaggtagatgctacatgggtaaaaacaggaaacagaattatttaataattctgtgactcataaataggattcagggccttcagaatgaaggtattggtggtattcacgttaggccaccatctgaaaggcataattttaggtaacagatagggaaatgtatagatcactgtaaagattctaatttaaaattctcttttactagacttcaattttataccatcttaacacatcagtctcttctactgtaaataagcaaaacagaaaaatcattttatgtgcagttttaaggacataaatactctccaagtatttcagatgaggcacttattctcaaaaggagatcttgaaaagttgatctgagaagaaattacatgatttcattttggaataaaaacacttaggttcataataatatagctttataaccttagattaattataacatagacgtcaatgatttagctcctgccatgtgtcaggtactttgtgtacattaaccccttaaaacaaccaaggttggatgtaagtattgttaaccgtactttacatatgcagctgctgaggcccagaaaaagttcttacataaccaagatctttcagctaaacagctatgaaaccaatagcattaaaacttgaacccaagtcttcctaactctccatcgtgtgttctttctttcagcattaccttcctttgggctaagaatcacattcacatttgttaccctaccctgcatgtgtattgaagttataacaatgaatattcaaagattttacaaaatagtagttaacagaaaggtagagacagagcccttttttggtgtggaatctcagtttattagtttacacatgtggcttgtatagaagttgacatccttataaaatattcttataaaaatatgtgtgtgtaggagaaatatatgtccttggtgaaaaggggtcaatggagaacatttgattcagggttgtttttacataagaggtgtaaaaacaaagccagccagagaataattttatagtcaatcattcagggaaagaaaaaagtcttgagctctaaggagaaagatcaagtcagaaatctgttaaggtttgactctggaagagccagctgggaatgatggccggctagttcaagtcactaagcaacagaacagcaaactgcttggtaacaagatctggcctgactcacaggctctctttgagtgacctaggtggccagatagaggaggaccaagacccatcttacctcaaaacaatatccttccatttccactttgccagccttcatgccaaattccacattatagaatagtctctttgacttgagatatttccttttagaatggaaatatctctgggactagaagctaatattgttgtctttcttctcagaaatagtgtttcagagattgttttctgtgattcaatatattatttaaaaagtgtaagctttaataagagcaaacaaagtggaaacatttgagttggtggtctgacttttggttttcgtaagcaaatgtatacagggccaaaactacctaccttcattgggtgcaatctttctttccttgggctctcagactgaatgtgttgacatttatttgtcattttctatgttatgctgtcttctagttcatgtttgtatttcaagtatgtagctggactgtaagttcctaaaaagtaagaaccggccgggtgcggtagttcatgcctgtaatcccagcactttgggaggctgaggcacgtggatcacttgaggtcaggagttttagaccagcctgttcaacatggtgaaacctcgtctctactaaaaatataaaaattagctgggcatggtggtgcatgcctgtaatccgagctactcgggaggctgaggcaggagaatcgctggaacctaggaggcggaggttgctttgagccgagattgcaccattgcacaacagaggagataccatttcaaaaaaaaaaaaaaaaaagtaagaacctccacattcatcaatcattgtatccactgtgaaggtacaagtgccacctgtataatatacattcaataaatagttgttttttgatcgattgagaaacataccttctgttgctgtgtcttttatgctgaacacccagggggatccatacccttccagactagaagtcctggtgatgttggttttgattgccatagtggaaaaaaactttgaactcaatgattaaccatttgtgtggactttgtcaccatgactcagtgtgtgtctctgtgtgtgtgtgtgtgtgtgtgtgtgtatgttttgggtttacatgcacatagattggtatagttggctttggtgtatatgaatgattctgtatcttattattctgtcacaataatttgtcaaatacatgcattttaatatttagcttatactttgaaaattatttatgcctgttatatttctgaaaaaaatctgtgtaaatgtatctatgattcttgggaaattactgaataactagcttgttaaattctgatgactaatccttatcttttagaattcataacagttaaattatatatcaagacctaagcttacaaaagaaatgtcaagattttgagaaatttgcaaaaaaaaacccttcatagtttcattttcagtgttttaatttggagaaattttaactggcagaaattaagtaccatttttccaaagtagatcttcagaagaactaaaataatagaaaacctttttgaaggggtttagcatagaaatattattttaatataaatatttttatacagttaaatattatatatatcatttttaaattgcagtaatttgagaccaatttttccccattacccttttgagataaccctctgattaaattagctattattaaaataaagtggcttcctcttcatgttattagtagggtaccagttttttggtttttttttttcatacatggctaatttcacatttataaatggtgaagtgtgtattgttgaccttttgaagcaagcaactttctgacttaagattacttggattatcattcctgcttgtttgccttctttaggttaatagtatttgttttactttgctttattttgtgcagtgtgattttttttatgaccttctattgagtgattgccaaatagaacagcgtatgatttatggatactaataactaaaatatatatgaattgcaggctgataatgcacaaggctgatttctacagttctcctctgaatagaaccaggcttcctttaataaagccttcttactaataagaatagcagtttcactaacacattgatcattcttgaatcaccttcacaattttaggtgcaactgtgggccatttatactgtttacatttaatatttctagtagacttacatttttatttaaaaggccatatgtttaaaaataaagctttgtatattactgtaatttggaactagcgtcatttattatgcatagaagataattgaaaaaatatacaataaacaaggcaaaatagattcaagtttagctagataaccatgaccttccaaagactctgagcctgaggtctgttctctgtttaaaatggcatttagcaaataatatagacatatgaaagaccacaattaagtctttcttcttaaggtaataagaattactgaaagggatttggaaaggaaataagcttctccttatttaattcaacattttaaaattcaataagccacatcagctatgccaaacaccatctttgtacaacctcaaaccatctaatataccaacctgaaccactgatacttccaccataggaagagggacatttgttcttgcagaagttcttctgttctcaatcccttagttgcaggtaaacacactgaacttggattgggtgatgctaatccctaagcagaaagtatgttggtactctgttttcccacactgtaattattaagttcttacctggtagctgcacagatgcaaaaaaaaaaaaaaaaaaaaaaaaaaaatgttctgtggaaaattctgtacctgccaatggtagattccaagttttacttccaaagagtgtaaacatgggtgttttaaaaagtatgtctcaatgcaaataaatgagagctaagtaaggaaccacatttttctaccctgtaatcttttttactctgtaaactaattactttccatgctagaatgctcacacagcactggctacgtaatttgtagggcccaggtaaagtgaaaatacagggcccgttacgcaaataaatattacaaatttcatgatggcaacagcactgcattcaatccagcacaaggcccttctgagagtaggatcctgtataacttcataggtcacacctgtgaagccagccctgcacccacaataggtctgatgtgatgcccagaaagtcgactttgtaagccctacaggtgatgtggaagccatacgttgagaaactgtcttaaagggacatctttttagacagtctcactctgttgcccaggctggagtgcagtggcacgatctcagctcactgcaacctctgcctcctgggttcaagcaattctcctgcctcagcctcctgagtagctaggattacaggcatgcaacaccatacccgcctaatttttatatttttggtagagagggggtttcaccatgtttgccaggctggtctcgaactcctgacctcaagagatctgcctgtctcagcctcccaaagtactgggattacaggcatgagccactgtacctggccttaaaagaacatctttattcataagctcctcattttacactgttgatagaaacttcagaagacaatgatatgcgttgaagtaaaaaaacagaagttccaagaaaagtcagagttggaccagctataaattaaagagaaacattatcttacattcatcttgagagttttctttgcaaatgaacacgtacatacacaaacaaacttaaagcagcattgcctttgcatttaaagtcacttactgatatgcacagtattagtcatggcaaaatattattagcatttgaaattgatgctcatccctctttgttgatactgtctcatttactggattaactttattcatatgagatctcccttttcttttcattgtctctgtttccagcaccttaattgaaagtacccccggttacataattattcctttgaccttattcagtatgttccctgcaccacaagtgtctctcctctgttcaattccaactgtcagctcttttaataaaccctactcttaaacctcatttcccaggctcaagttccatatgcctcctctggacatttccacgtggaagatccactcttaatttatatttaacacgcacaaaaccaagcttactgtgcccccctttttgatttttctacttctgtttatctggccattatcttcccaaaaaaccagaaaaaatcatatttgacttctgccttgccctccttctgcctaggcctatggattatttcacctattatctcttgctgttctgttccctcccaataccaccaggtattttaatacttagatttgtgtttgatctatttcaataacattctaacttgtctttgtgccactagctccttcccactaaggatgtcctacttatactgtctcattaattaccctacagttctgctttgattgtccactatctatagcagaggtgaacaaaaggaccagaaaataaatattttaggctttgcggaccctatggtctctggggcaactattcaaccctaccacggtagtgcaaaagaagcccagatatacaaatggacattagcatgttccaataaaactgtatttgcaaaaacaaataggctgaatttcgcccactggccgtaatttgccgatccctgccctgtaggataaagttcacacctttaacatggcatctaagcatctgtcatcagttctgcacctatctctgcaaccctatgtgttattgtgtcctatggatacttcacatccttcgttttgaagccgaatctagagcagggttgctcaacctcagcagaactgatgactgggccagaatgatgctttgtggtgggggctctcctgtgcattgtaggaggttaagaacatccctggccactgcccactagatgacattaatttccaccatgaggtgaaaattcaaaatgtctccaagcactgccagttttcccttgtaggggacgagggattgttttcagttaagaactactgccctagggagtaaattttgtgaaggggagaaccagttctacctcattcacaggtgtatccctagcacctagcacagtcttgtgatatacaaagaggttcaggaatctattgcatagtccaactctgctactcactgtgggatcctagggttatttaaattccacaaatcacaattaagttcatctgtaagtggaactattactaattcatacatgtttcataaaattatttagaagttcaaatgatatatttaacaaaaagacctcttgaaagacagtagtactttcaaataaaaggtaaacatacaattgatagaacactgaaggtgatctgagcctattgaaatctagaagcttaatttgactcacatactctgtctacactgtacaaattactatatgggatgttattggggcattgtctttgttctcaaggattatgacctaacaggtgttagaatatgattactcaaccataaaacaatagttgccataactaagcataaagagtggttggaatttatgggagggagacattgtatctggtactaggaatcacttaagacctcatgagtgagatgaaatagtcacagagaagtcccaggcaccctactgagcattgtcttagatgatctcattgaatattcactgcaacttgattaggtttaggttttattatcacatttcacaaagagagaggggcctaggaaggaatttgatatgaatgtgaagcatgggagatttcagcagggagagaactgcagtgaagtgtggaaggaggggaagtgacaggaggtgttttctcaccaagggaatagtgtgaacaaatatggggattacatggggtttaggtgagtttgagtgcctctagggaaggtaggttggaatcagattttgaaggattgctaacatctctctctctcttgctctcgcttgctcgctcgctcgctctcacatcacacacacacacacacacacacacacacacacacaccagggatttatatgtataaaagaaacatgatgatgttatctttcctaacagcttcactccacataacaggaagtgacattttgagttcttaccccatgctaagcttgctaagccacaagtatgtgcactgaacactttcaatagttggactttgagactcagttcaattagaccaatctataccatctttcagctagctactgctcttctacttttcccaagataatccttctgaaatagatacacaatgctgttttcattcaaatcagatgtgttaattctactagtggcacttgtgttctgatgcatagaacagaggcattatttacgtgaggactgtgccttccttcttactgaattgcaaaagtatacaattcttagaacacatctagcagttctgaggggctggacacagaaaaccatcttactctgaaggtaattttctctattttatcactagctcaccaaggtgagagtcaggagtgaaatatcctattttcttttcatccattcaaaaaatagtttgagtgtttcctgtgtacctattgttcttctggagatagagaactgaatgaaatagacagtcttccatacattggggcatactttttttttttttttttttttttgagacagggtcttactcttttgtccaggccgcctagagtaaagtggcatgatcactgctcacctaagccttgacctcttgggctctgggttcaagaggcctcccacctcaacctctcaggtagctgggactacaggcacatgctaccaggcctagataactttttattttttgtagggatgggggtctcactatgttgcccaggctggtctcaaacttctgggctcaagccattctccagcctcggccttccaaagtgctgggattataggcatgagccactgcatcaggctaaagagcacatattctaataaaggagaagacaacacacaaataaatattccagtgggtcagagaaagacaagtacagtatagaagaataagtcagggtaaggagttacagagttgtatgtaagacatttcagcagagatctgaaagagatgactgaacgagctatatgattatccagcagaagtacatttcattgtgatttcaagtacgccaaatgtggttggcgtatttgagggaggggggaagttatagaaaatgaggtaggagccacagaaaggcatcagatcacatagtgctttgagcctgtagtaaagacttgggtcattccttggtgatgactgtgatgtattgaagcaaaaagtgttagtagtaggaatgtctgtgttaggaagggacacagtctatcataagttttggaagaatcatcccggctcctgtgtagaaagtaaagatgtggggaaaatggaagcagagaccagttaaactattgaagtaacccaggtaacatgtattggcagtgtggactagagaaatagaggtaaaagtagttaaaaaaaaaaaaaaaaaaaaggtcataattctgtctaccatttgaagacacagccaacagaatttgtggatgcattggatgtgaagagtgagaaagaagaatcaagaataactcttaagtttgtggacttagcaacaggtagaatgtagttgtcatttgtcaagctgaggaagattgtggaaggagcatttttaggggaggtggatcaggagtttagttttaaaaaatttattttggggatgcctcttagatttctgcatggaggtttcacttagataactgaatgtatgagtctgaagtttggagcacagattagcacttgagatgaacacttgagagttattaaaatgtaggtggtattaaaagtgataagtctgaatgaatcacccagggagcaagtatatatagagaaaagacctgagacagttggggcactttaaaatctagaaatcaggaaaatgaggaaaactcagcagagaggccagtgaggttgaagaaaaattgagagtgatatctggaggccaaatgaacaaactgtttcaggagaaataagtggctgggcatggtggctcacggctgtaatcccagcactttgggcggatcccctgaggtcaggagtttgagaccagcctggccaacatggcaaaacctcatctcaaataaaattacaaaaatcagccaggcgtggtggcaggcacctgtgatcccagctactggggagtctgaggcaggagaatcatcacttgaacccaggaggcagaggttgcaatgaactgagatcatgccactgcactccagcctgggtgacagagcaagactctgtctcaaaaacaaagaaacaacaacaacagaaaagtgataaactgtggcagatgctgctcataggtcaactaaaataagaactgagaattgatcattgcattggcaacatgcagccaattggtggcatacaacacaagtcgatcagtagagtagtgatgatacaggactgactagagtggaatataacaaatttccccaatgcttaaaccaacaagcatttattattgcatacagtttctgagaaatcagggagcagcttagctggctggttctgactaaagttcctagaagaaattgcactcaagttgtcagtgaaggctatagtcatctgaagctgtatctgggactggaagatcagttttctaagatggtgctgtccgcaggcagccttgctttacactggctgttggcagaagacttcagttcctcactgtttgtgcttctccaaagggctgggtgttcttttttttgttgttgttttaatactttaagttctagggaacatgtgcacagcgtgcaggtttgttacatatgtatacatgtgccatgttggtgtgctgcacccattattaactcgtcatttacattaggtatatctcctaatgctatccctctcccctccccccaccccacaataggccccggtgtgtgatgtcccccttcctgtgtccaagtgttctcattgttcaattcccacctacaagtgagaacatgtgatatttggttttttgtccttgcgatagtttgctgagaatgatggtttccagcttcatccatgtccctacaaagcacgtgaactcatccttttttatggctgcatagtatttcatggtgtatatgtgccacattttcttaatccagtctatcattgttggacatttgggttggttccaagtctttgctattgtgaatagtgctgcaataaacatacatgtgcatgtgtctttatagcagcatgatttataatcctttgggtatgtacccagtaatgggatggctgggtgttcctacctcaggcacaggagtcagtgattcaagagagtgcaaagtagaagccacaacgacttttatgacccagacttggcagcaacacactattactctgccatattcttctgctcacatgtgccaaccctggtacagtgtgagagaggactactcaaagttgtgagtatctggaggtgaaggcctccttataaaaggactaagtcaagtggattcaagagatgatgggaaaagaagtggtggcaattgttaactcttggagttttgttgtaaagtcagttggaggggataggaagaaaaatgagatatgggcaaagggtgtgttgtcaattgtattatgtttgtgtggttttgagaaagaagcagcagaaaggggacatttgatcatgagaaactggggacaattgcaggagcaatattcttgaggaggctttgggggaataggggtaaggagaagttcagatagtgcacaagccaaggagttgcccttaatgggagtgctgattgttcagtcctcacaataaatgagaaagaagagtaggacagtctgagagtataggaggtcagtatcttgatagatctggtttcagagtgtatgaaaagtgtctcttaattccttctattttgtgataaaataataagctcatcaatgtaaagacagagaacagatgttggaggtttgaggagagagaaggtgagaaatgatccatcatctctgggaggagagagtgctttgtctagagaaatgtgaaattcccagacggcactaaggagccacctcaggccagtagttacaaattcaaagtcatcatggttgtgtttttcctcaactatcattgactgcttaggccacaacaagcacggtttgaaaaaggttggtttaacagagatgagatatttcagtgaagtctgagttttaaaaggatatgcaaagaagtgattatgctgccatatttactctaagctcactaaggaaaaggggacataagtttggtgagggtcagaacaacttctaaggtcaatgcactggaggactcattgggtttggaagatttttggagtcagaatactggaggggatgagctagaaagagagaaggtagggagagacgcttaacagtggttatggggcaccgttatctgtcatggcaaggccttgcttatggtaaggaaaggaggtttcaggtaagattatctgaagggagatccagaaactgggagaccgtgggaggaaaagataattatgagttatgtaagagtttgcgctggagagagacagggctaaaatgtttaaagactgagaggagagacctttaggtcagtagaaaactggattaggaggggagcagattaatgatgtgagttacaaagacattttagggcaaggaagagatcatggtctggaagcagcagagaagaatgagaaagactcctacttcactaggggcagaggtacaaacatgtggaaggaaaaatagccactgcatcagagggctgaagtaaatccgtattctcggtgggcagccagtagtgtcagagcaagatggtgcaggaaagtcagagaacatgctgaagatacaggagcataaggagattttgctgatgacagactgaacgctaggagtcacgctggcgagtttgcaggaattggggaaggctggggatttcaaagtaggggatttacagagccatctggtgatgagcaatgacctggcagtcttggactttgtgtggtgacggttgtgtattcaagacaaggaccttggttttaagaccatgtagtcagacaagcacaaactcctctgctgggatggccggtttctttggtctatttaattagttccagaaacagtaattcatcctcactgcatttatagaaattgaggggagaggtggtgggtaccagactggccaggtctgcccagtcatcttcacttcaacattcctgtctggtaaagtcatattattctcacatcttggccgtgtgtgtatgctccaagaatgagacagatgacagaagatacagaaaaacaattgggaaattgctagtttgcagatgtatagccctggcacagattttctaatatgaaattgccattttttccatgatttggacacaaaatcctgttcttgaatatgatgttcagcctagatattgaagaactgaaaaatatttttgaaaaaatatatatattgcatttgtcacaacagtttatacacataattatcacaatgatattgcttttcttaaataaataggttttatgtgttggcatgaaatacttttacaagatgatgccaggttttaacatttatacaggaatattttcattatcataattgttaataaaacaaatatgaaatgtatagctttctctttggagtttgaattgttggttcttactgcctgcttgcatatttatattagttgtactggctggcagttattaggaaatacgatcttctgtgtcttaggagtgcgccctgcaagcaacatgtgcaaacatttttttctttctttctttttttttgccctaaggaaaagggtaagctctggcaccttttaacctgtaaggattatgtggctcttgctgtgattgattggttggcttctcctcaagaaatgctcctggtgcgtattttatgttctcacagagccagggctttgctgatcagcacgtcacccctgtcaagacgtgggcttgcttttgtgcatttgctcttgcagcctgggaagcatatttcaacacactgtccagaattggctagaacatgcctgtcactcccagctgactctgatgacgctcttgccaacgtagatttacatcaacacagttctttactggaaaaagctcattcagaatatacagggtggcccatttaaaagaggcatagcgtcaatttgaagagaaatatattttaaagggagaactctaagaaatacacagtcaattgaaggctccatggagcatagaattataactagcatcacccgagaatttttcccctggagattgtcctaagctctaacttctagagactggcttatcctgaaaagagaacctttctgttctagactttttctttcagcatgctagatatgtaggcatttttagcctcttctttccctaaccatataatctgaacaccatattcattgaagaaagcatgagatgtgaaagctgataagatgcaggattatgtgacaccattgctttttacctgtgcaaaattcagtttggtaatcaatggaaatacagattttacccttcacataaaattgtttggcatatgtccatcttgttttttgactcatccttgatatcacaatgaatgtttgggataggcatattactcagatgtgtgggtctatagacaggaaatcaggcattcagaaataaagcttgttaccatagctatccaggaaaaaaatacaacactgtctttgctgtacaaaagaaaaattcaatactactgtcacatgatatgtgattactattattatgacccaatgctactcacccttcattttcatcattctagtctatttcaggtcattacagtaatggatacaactgaatgggtttgtaattttaccccttctctcatgacaaccagcaggattctcaatgacacatgctttgatctgtctgcttttaaatctcttaagcagggtggctctagatagcttcctctcagaagattttatgattctaatagacctcatgatgagttctatatttgtgcttgtttagatacatcaaagtcaggctttatactagggccacctggaaagttaaggtcatcagctttttgttatagtcattggattactgtgatgctcagcaataacaaagtttgaccttgtaaagtgatcaaaagttgtgggttacaatataggaatattaaagtatattctgccatgatgtgtcttctgttgtagtttgtctagaattaatattacagtcacaattaactccaaagtgttctatactgcttgcatacagtacagtgggaaagaagagatgtcaaaatcagagaaataagattcctccattatgaattaacatacaaaatctacacttaatgcatcagaactaagatgcaatgttttaaagagattgagttgacaggtcaatcagatggtaggactggtaagaatttgagcaggcataaacaattggcagtatgtattcaaacactgtttatgagagtgaggaactattggttaacaagctgacattaagcatttagattatataaatcaccttattaactgcattctatctatggatctattatcgatctgtatctatctatcgatctgtctgtcatcttttgttttgtctggttccatgcttccaaagacattttctgatcttcattgttacatagtactctctactgagtcctaaagaacacagttctgtgtcaggctgattgaagtgtaatgatttgagtgatgattgtagtgctcaatgaaaggaaataaagaatatttggactctgttcagcagtcatatgggcttgtacaatatgagtctgcttttgagagaagaaacttgcacaaatgtctctttaagagcctgcttttaattcttttgggatatatatctaagtgtgtcttaagatagttctatttttaatatattttttcatactgttttccatagtggttgcaccattttacaatcctatcaacagtgcacgagggttcaatttctccatattcttgtcaacacttacgtgtgtgtgtgtgtttacagtagctatcctaatgggcatgaaattatatcttattgaggttttgatttgtatctctctattagtaatgttgagcagcttttcatgtacttgttggccatctgtatatcatctttgaagaaatgtctgttcaagttatgtactcattttttggtggagttatttaatcttttgtttctaaaatgttttgaatagatcaaggtttaacagtcattcctctgtgtgcttttatgtcatgtttagaaatgtgactccattttaagcttcttaaatctttttttactttaccattttttgggggctctctttttttatatttaacttttgtctatctgtaatgtgttttgattatgaagaataaggaaaaaatttagggtttgtttagcttcccaaaccccactttatagaataatcactgatcatgtactaacttataatacttgatcattttaagtaggctttgttattgagttccacatttggcacacctactggtgtaatgattgctctagtattagtgcaatagtatcgtgttagattttgtttgcagtgtgctaagtggtaaacctcagctattaatctaccttgactaaatatgtaattgttccctttattaagccctattttctttcaaaataaatattaactatgtttcccactcattcttttttgggggaagagtaaatataaagaaatgtttccagcaatgtgggaggccaatgtgaaagaatacttctatattatagaatgactatttttgcaaatgcaaaatgataacagaattcccagataaggaatagcaatgactgtttcagggcattacctaagtgtgtttcttgggctaaatttagaatgcctgattactgcacacctggtatgaaaatagaaaacccttgtgcctacatcacataatgcttaccacattgaggtacagataaaagaagttctagaattagggttgttcaaagcctggtttactatattttggatataaaatggagtaaatctcataatccttctgaacattggttttctcacttgctaaataggaataaataacatgcatgaatagtatagaatggttgtccatgtgtctaaacatgataatttgtggggtatgtactttataaatgattatatgcaaaaaggatggccagacgcagtggctcacgcctgtaatcccagcactttgggaggccaaggcaggtggatcacctgaggtcaggagtttgagaccagcctgaccaacatggtgaaaccccgtctctactaaaagtataaaaattcaccaaatatggtagtgcatgcctgtaatcccagctactcaggaggctgaggcaggaaaattgcttgaacctgggaggtggaggttgcagtgagccgagactgcgccattgcactccagcctgggcgacaagagcaaaactccatccacaccctaccctccccccaaaagaagatgatgatgatgatgatgatgataattgatatcagtaacaacaacagtaatactggtgatagaagatccttctggtgcaaaccattctcaacaatatgtttgctccagagaaggtagggccagactcctaatcccaatgttgtttaaaagcccattcagattatgaattcatttgaagcattttaggacccgagagactactagaagtttaccgttaaacttagatgacatacagttagaaaaattttccatagtcagctttttcttctcctgttatcttctgtattttactaagagaatgtttagttttaactactagaaaaacgtaatttcaggttgattaaaagagaagaacctagatatgtaaataaagatgaatcttttagacatgtagtcagtagctttcatgttactaatgaaaagttcttcatatcctatgatttgaaagaggaaaatcaagttttgtggaagaaaatacgtgaaattttaaataaatatacggcaactttatatagccagagttaattcttctttttcagtaaattgtattaccctgaaacaccaaaatgtcaatagtacaattatggtcatattgagagcacttgttattagacacaccctttagatttttttcttttgaatagaaactgcaagaatttttaaaaactgggcttattgactggacgaagggttttaaaaagaacagaaagacaaggcagggcaaatcctggtgtatttcacctgcgtagtgacatataggaagaagggacctttcagagatcatcttgagttttgactagatgataaaactgaggttcaggatggcacagaaaagtgtccaaggtcacacatttaggaaaatgtgggacatagacacaaattgtttgatgtagttcagtagtctttttagtctgacccagagcctttggggatggggacggaaggagattgggaagagcttgtcattgattcagtatctctgctcagtgccctcttgaggtttttgtttgtttgttttgtttttgtctttctggtatttttctgttgttttgatcctggatttggagtacaaagagactaaaccattttccatattgcatacctgactttgacttacactaggtgcattgaatgcaagaagcagttatgtagaaatgaattaatagataaatttactgtaaatctagacctttattgttgttcctcctatgctactagttagctgagtgatcacaggcaaattacttaaatcctcataggctcagtttcctctaatttaaaaggagagtgttgggtagttgatctctaaagtcctcttcagtgcaaagtgctgtgcttgcccctctttacctgaataattcctaagattgctgaagcatcattatctccttgttcttagctactgattgtatatttaattccacaattgggtttatctctattttcattcatgcatctttgtatcattaattccgaagtctcatataaaatctttaattcaaaaaattgagtgatggtacaagaaaagcaaactgcctatgaattccacgtgattgtgcccctatttacaaggtataaatgtgttaagaacttaaaagtttttgagtattgattattgttgccaagtcgtcaagacaatgcttataaagtaatccattatccttttccacactcttttcccttttagaacaaaaataccagcaagaaaaaaaaggatgactgttccaggtcatcaagaaagtagactacttggtcattatcaaaaatattttgaacatgtgggcactttataaaacaaagaataaacaatagaaaattatgtacttagaaagtccagactgttaataattttctgcacttaacacagtaagtgggcccacagacattaaggtactaaatgatttatagatgaatttattattcagtttcaggacaccagcagcaataaagtattttctacttttataaataactcatatggaacttttatctagtgatacactaactcttgtgttagaatgtgtaaagaaaatattttataatgcaattgtacagtgttggagtgattaggattcaaaccttcaacttccaatgagaattttaatacttagtctttaaaaatagtaaactgagatttatatttatgttatttcataccatcctatattccataatcttctataacatgattttatattcctaccttttattcaaccattctcttcatattggacattggctgtttttaattgttttaagataagcatacttgaaggtcaatcctggattggtgcattaagatgcattctcagaaatatgatgtatagagttaaagaacattttaaaggtgacatcgtgttctgcttttcagagactgttagcagtgtgcttgtagcgtattacactgctgtatcgctgtatcactgcaccatctcaaatattgagtttttttatagttaagtatttataaaattaatatgttggataaaatctaatttatctcaattgattaacattgaggctgcaaatatttttatagtgtaaaagaattttctattgtgaattgtacattagtgtcttattgagacattaacatttcctgtctttgttgttgttgctgttgttgttgttgttttgacacagagtctcattctgtcacccagggtgaagtgcagtggcacaatcttggctcattgcaacctctgccttttgggttcaagcgatcctctcatctcagcctcccgaatagctgggactacaggtgtgcaccaccacacccagctaatttttgtatttttagtaaaaatggggtttcaccatattgcgtaggtcagtctcgaactcctcacttcaagagatctacctgtcttggcctcccaaagtgctgggattacaggtgtgagccactgcacccagccctttctccctcacacttttggaaaaaatatttttctcagtttgttgcttgccatctaatttattacattgctttttaatatacaactatagacaaaagaatcacttttcttttggaaaatttgatctatgactttcattcatataaaagctttcctcaccctcaggtcaatgttcacctttatttttttctagttttttttaaactttgtttttaatcactgtgaaaataattgaaagatgatatttagataaaaatttgtgtaaagctctactattttgatacagattgaaaaggataaaaagaaatgagtaagaagtatgcgtagtgtttagaatgaacatgaatgataaactaataggtattattttacaaattatagaatattaaagataaatatactctagagtatagaaatatattttatattattatgttaaaatattaaatatttcaggcatgtaaaaatagatgatagtgtagccatttatgcatcaaagagttcaaaccatacaacactaaaggtaaaactggggcccctagtgtacccttccccaattctatcacctttccttcccacccagaggtaactactattatgtgtttacttttcttgagtatgttcttgaataggtgtgtattcaaaagagacagttcctttttgcactttggaaaacaaataattctgccttcccccccatgattgcattttatatgttttactaagatatttattataataaatattacaccacttttctctgtcctattcatggggaaaggaactctttttgttcaaaatttgtcattcttatattgtactgccccatattctgcaaatctgacaacagaatacattgtatgacaaatgtgatgtttggtacaaatatgtcagcttatgtatgctgttgcatgtgttgctcagcattgcgtgtattactgagcattgcatgtatcacttagcctgtctataaaaaattgagacatttatttaaataataattgtcccacaatctattcatgtttatgcatgtggatatttgaagcaaaatatgccatagaaacagtatctcttgctcactgaattttaaagtattttaacatcagtagcaagtgcataataaatctttaatgtataatacgaactgatagaaaaatagggctctgcatattttttcttgaaaaacaaatgtgttttgagaaatatagctttgtctaatgctgcctttgtaaaaccgggaagtcaaaagacaaataatattttgattctatatgttatgttgattatatatagtatgtatgtgaatgtgcataactatatggattcatatatgcacatatatacacattcatttatactcatgaaaatggtaaaaatccagctaatgatttaaacattgggtcaatagcaatatataaaaataatattaaacattcagatctttgcaaaatctaaatgggcttgtttttaattttcatgtggacatttgaaattttatagataagactaacaatatgttttactgtactgtgagaatttaagattaatgaaatattatgttattaatttcttacatttgtaaagttgtttttcacaataccgtggcctattagattgctaagaaattatgtatgtcaactctttctttatacaaatattgaaaatgatagtaagattaaggaacttgcccaggtcacaatttttttctttcaaatttcatggctgatttctaggcaaaaatttcaggggcctgtccaatacgcatgaattaccctactataaacaaagctagggaatttaatacataccgaaaggcattttgtaatatatcagaaactatacaaaaccaagaatagtcataaaataacattttaacatttttaaaaaaagattattccaaatgccctcacttccaggaatgcgactttaaaagcctaggctttatgttatgtcatcaaagtcattgtactcaattagacaatagtgctataattaattaaatgttattatgtaaatgcagaattaccaaagagaatttcaaagagtataacagtattaagtcgtttccttagtaatttctcattgctgtgaaaaacatctgtaacctaatacatttatattcatttttcatattatattatgcacatattatttttaaatatttgttaacaggtaattttctgattaccaaagtaatacttttgtattaaatgtttgaagactgcctccaaaaattgcaaagaagaaaattttaaaaccgttataatcctacctttgaaataattattcttcaaatgttagatatttggaatgtttccaggtgtttactggtatagttaatgctgctgtgaacatctttattgcacataccttttaacctctgtggaactgattgcttctttcatgatttctcctatattttgtcaatcatttcctttttttctttttcttttttttttgagacaaaatctcactttatcacccaggctggagtgcagtggcatgatctcggctcactgcaacctctgcctcccgggttcaagcaattctcgtgcctcagccttccgagtacctaggattacaggtgtgcaccaccatgcccggctagtttttgaatttttagtagagacagtgtttcgccatgttggtcaggctggtctcaaactcctgacctcaggtgatccacccgcctcagcctcccaaagtgctgggattataagagtgtgccactgcacccggccaattgtaagaattattttcaaaggaatttatatcaagttacagtgccccagaatattctgttattttagctgtattgaatatcataattttcttaacatgttttgtctttagatggtataaaatactatctcaatattattttccatttgtttgtttaccctttatatttccatttgcttgaactctctgctggaatctttcaatatctacctgatgaatcaatgtttatctgttggtttgttttctttttttttaattaattaatttattattattatactttaagttttagggtacatgtgcacaatgttatacatgtattttatttctttttgtcacataaatttgactctttattttaagcaactatttctagtcttttgttttttgttttttaaatttttattgtaaagaagttttgttttggccaggcatggggtggctcacacctgtaatcctagaactttgggaggccgaggcagatggatcatttgagacgaggagttcaagatcagcctgaccaacatggtgaaatcccgtctgtactaaaaatatttaaaaattatctgggtgtggtggtacatgcctgtaatctcagttactcaggaggctgaggcaggagaatcacttgaaccagggaggtggaggtttcagtgagctgagatcgggccactgcactccagcctgggccatgaagcgagattctgtctcgaaaaaaaaaagttttgtttctgtgatagatattttgcttagcatgcttgctttttatatttagaaaaactaaatctattccatctaaaatatattttggtgaataacgcaagatatgtaatctcagtgttatttataaaatgtaccattctcactttcttattttgtaaagcttgtttaatttcagagtttgatatattgaagagtcctattccactgacttaaaaaattgaggcagaaggatccccctcaagtgtcacatcttagaatttgtttgatggtacttcaaggcagttggtgaataatttagaactcaaactttgggctgcagattgcctgaatacaattaatagaaaacaaaatatttcctcaaattacattctttgacattagtaatcattcctttatatacatctcaagtctaaactcccaatctgtttatatgcagagattcacagctttaagatttatgtttcataactgcaatatcactctatgatacattaatgggattctgtactcaactattccattggcattcaagtgaataatttttatacaaaacttcttcaggagacaggcccaactgaagtgtatcactttaaaacaaatatcctatgggcaatagataaatctgatatttttctgagtagaagaaacataaaacctcaatataggattaatagggttcaaggggttttataagcacagtgcttgtgaaagtatgtaattcctattaaggcttgcattcatgagcacatcatggtatatgctctctctgggaatatgtaaagccagtttaaaattcaattacagacattgcagtctagacctccgcaagcctttgcacgtgactggactcactcaggttaatctctgaaccagttgtagagagcttttttcatctctccctcacacatttccaaactcttttctttctgtgttttttaactgtgacttttctttacaaaaggaaaagagaattttttttaagtccatgacatatccaatgaaatcgaaatgatttaatacatggagttatcttaatatcttttgcttcttgacagttctctcatatctatctagaaaatatctggccaaaaaaacccactttactttgtttatgagatattagattattttgtacattttcacattccagggctacaaggagaccacagtagacaaaatcaaaccgtcttccttttctttataggcttgtctcagcaatgcagcactgtaatgtctcttacttgaaggaacttcattctattgtaaattcttaggacaaatagaataaggagatagaagagttgtgtgagttataacttatatgtaattttctgtatatatttggaaagttcaacatcagatattgagtctatttcagtctgttgctgtgaatagaatacactattttatcctattggttcttttcttaaactgtcaaccatggtttgagcatagtttaagaaaaaaaaaatgaatgctttaaataaaaccagtacctgggttggaggtggcaaatatatacaaacctgtgtatgtgtgtttgggtgtgcgtgtaatctgaggattatagccctgtatctgtttcagggagaattttttttacatcagaccatgaaattgaaaggtgattctgataatctatttcattaaatagaagtttatgataccatagactctggaataaaaaattccttaaaattccctatttagattaatgcagatttaatccttaacccattggttcaaaactcaagtttactctttcagtaataacaagaagtggttgtcaataatactctcattaaaaataattatttcagcatttaaaaagtaataaaattggtattttctaacttatatgcttaatactcatccacaaaggttaaataattaagaaattaaagactgtgaagaagaagggaagaaagaggaaggaaaagatggtaatatggatgctattaccattcacaaaaacaacattgatgattaggcatatgttgacatttcaattttttgaatcttggtaaaatagtcattttaataacatacttaccagattacttaaagtaacatttcaactctgtttcagcacagcagataacattctaatccatgtaatcataagtagaaaaagcagaaagaaatagaatcctaacactttccaagcttccttctcttttgttagattataattcatgtacatccttattggggtatgggagacactggaacttattatactacatctcatccatttgttctgtctccatgactgacttctcaaaataatctaaactcttcagtgagccctttaaagtcatggttttatcctatatctgtccaggattttatctcacgttttgcatgtatcccagctcaaaaggattacttttctgaactttcattgcccttggattttgaccttccatatacttgaaattctctctttttaatatcaccaccaataaaaatccatccctcaagacctcacccaattattatttcaaactctaaatgctgatcaactatgtggagctgaccttttcatcctgtaaataagtgttattttctccttaagggatttgccacatgaaaactttgcaaacaaggacagtgtcttattcattttgaattctccattgtgcaatttctagctcactgtcatacagaacattactatcatatttagaggctgaataaatcattaaatggataccatcactgggcccatggaattgacttacttaactcaaatccatgtgaaagtcacttaataaatattaaataccatcaattctcaattattcatggggttattattcacaacttacttgtgatatgtccttaaaggtcatatttacataatgaatgattctgcctatttcattggcataaataggttcatttaaacagatttcattatttaattagctccaatttttcctttaccatctttttcagaaggcaagattttgcttttagctgtcttgcctaaatctgaaagctcatactgatcatttccatttaataagggaagatgaaaagggccggtcaggggactgggatccaaaaggtcaagagttttccattccttcttccatcagatcttcatagtggagttttgttaatttgtgaatttagttcaatgagccaaaaaaaaacttgctgatcaaaacaaagcccctttggtagggaggaaattctgtctctttgttttctcttcctttctctctgtgcgtgagtgagtgtgtgtgtgtgtgtgtgtgtgtgtgtgtgtgaatgtctcctgacatttgaaattcacagtgcaatttaacaataaaataataaaatatagctttttacaaaaggtgtaagcatagattaatgtacaggttttcagagaaggacaggttagcttgcttcatttttaatccttaggtaaaacagaggaagaggaaagtgaattttattgaaattcacactatgtacaatgaattacaagagaactataggaaatggttagatatgattaaataataattattttgaaattaagataaatgtcaaatgggaattatttgctttttcattaggaactgcaatgatgtttgcgcagcagtgatctatctagacagattttggaagatgtcagcaattttgtttagtctgtcagcatttgcagtggcaatgattgggatttacttgatgcattcactctggaaaaaaccttttgtgcacattagcatgacaactggtgtccatgaaatacaagaacaacattcagttataatgcactttacaccaaattaatgaatagtttaggaagggaagcaagagctgacttagatgacttacaaatatctgcttttttgcattttctaaggtagataatttgtgtatatttactttaaaaagtattttgtaagcaaagaaatgactgaaggaaacattaactccaacaaaacctaaattaatgtgtgtcaatgtaataaacttaggaagaaggcggttgcttgaaatattgtagtctggcaccagctccttcaaaatggccatgttttaaaagtatggcaggtgtgctaaaaagtctttattgcaaaatcattagaaagtctttttttgtcagtttaaaatgcattcagctataagcaatagaaaactaacaatggttgaatcatctaagggtttgttggtcttgtggaaaaggatatcaggaggtagcaaactagggctagtacagtgattctatgataccctcaaatatgtgatttccttttattctttcttctgtgccagccatcctcagcatatgggcctgtcctgtgcttgtcatctcacgaccattggcgatactgctcccacggcactatctcctcattccagggtaaagaagagaaatggaaaggaagtaggaagggatggtgtctgtatcagggaaacaaggatttcttaggaatcctcagcttatataaacccagctaccttgcccctctctgacaacctgttctttggcaagaacaatttcatatacttgcccctaccttccagggaagctgaggagcttgttttttttaactagacatattattgggtgattaacattaggcttatataaataagaatgaaagggagaatggatatcgtatatacaatcagcagtgtcagccacagtcttatagttaagtggacaccactaaatttggtgggattagaaaagcaattagttggtgagatataaaaagcaatataacataagggttttcaaacaaaatatcagatgatattacctgtatactattatgttaggggtataataccataaatatgctaaattcagattaataaaaagtttttcactttctgcacaatcatgacctccttttattaaaatagacaaatagtctggggttagtcacacaaagtctatatggcacatgactacaataattgatctgcaacctctctgttctttaaagtgattctgtgatatcaaggagtgttgaaattaaaccctggaagccacagaagatgccaaatggacacattttgtgactatttatagctgatccaaaaatgaaaggggagaatgaggaaactgattgatagtccccaattctgttttgatctgaaatagcttgttaaatgaatctcattgtcagagctagtttaaataataaatgtctctactctccactattccgtgcatatgtgagtctgaaagtaaaagtttgtaattaaagtgactgcattttaaagtttaaaaattgatctcaactaatagctaatactaataaaataaataactgcattctaattttttaattaccctggtttggaagcagaaacatgttttgtacatagctgtaatgttatttcactttaacctggttgtccccagtttagtatctacgaagctttgcacgtatcggaactccatacctgcttctcccttggtttctcttctcagtgataaaggatttgacttctttcttccccattccagcttgcacattcctgaagttttccggcttggaacaaattatattactaggtctgcagtatcatttagattgagaagtattgtgatagagcaaggttcaccctaagtattgactcttagaatctgctcattccatagtctgttgagtgcctttacctgtcactgttgtcctaagcaccaggagtgtagcgatgaaggatttctagtcctagttatctaaggactcacaattaggtttctattctggggctattttgtacatttgtgtacaaaagactgcatttttaaggtgtctgacttttgacttggtttcagaaggcataagaagttggtttcatggttacaaccccatgcccagaaaagttaagagtggtatttttaattaatttgtaactagaattaaatatagctagaattatataggaatacaacaaaagattaagatgtatatacatccctctgaataatataaatattgacaggctgatattgggttttctagacttactttcgtaggtattttcttagtatgaagatagttaaaatatactaagtgaaaaaaaaatactcaagtcactgtattagtggttccactagtaaaactacagacctcatctgtttctggaatttgcaattttaaatattgatttttggaatgtggcgacttacactgcctacttttagtttgccaggtgagctcatttttgaaaatatcctatactctgcatttatcctttgataaaatcatggctattataaattttaaaaatggtaaagatcatgtcagaataatgaatcgtgcttctaatttgataaatgtagcttaatcacaaatatacgaaactttctgttggtctggtgcaaactttctcaaggagaagatttagtgtttcagaaccattggagtagatgctatattaaacattgaggctctctcacctttaactttataaagctaaatatagtcaacaaatgaattggaaagacatattagtaaaatctaccgagtctaggcaggcctatgtgtcaggccaagatgcttcctggaattattctgttcagaatgattcctctttctttctcattctctaaagataggatgtcaacagtttcttcataaatgtaaggttataaaccatgacatttgtgaaactattgcaataatcttgggttgtgtagggataggatgacattttcagaggaaattctctaaacactttcacattaataacatctgggagccataatattataagcataagaagtggatctcatataaaaacataaaatatttttttcacatttatatgaaataacatatgtacttgtaacaactgagagtccctgatcaaattaggaaatctacagccatttattttaaatcttgctctaccaaaattggattgagagacaaattaaacacaaatcattagttacattttataactatagaggatgtgcagaaaacaaatattcaaacccaattttatgtactatattgtgccatatagtcacaggaaatctgttttccttctaaattattaataatttaaaatcatgaataattgtttatgtaagacagctggccaggctattaagggagtacagctacacagtaacaccaagagtgaggtgtccatctgagctaccacatggagaaagagcagctggctttgccccaccatattcagttgaaagctgcttattactgagcatttgaataacttgaaaggagagaaaaggaaagaacaacgtcagggtagaatgtttacttgtttgagcctcccaggagaaatgccatacaaagatttgacttgatttttaaatcaaaccaaagatctttcagattacattggagggctgaattgaaagttaacattgtataagttgtattatttttatgttcttttgtattatactatgttcccttttatattatgttcatattaccatgaactttagagtcgggatagatcagagctcaagtcttaatgtcatctcttccaaactgtgtgacctgggaaagacatttaacgtgtctaagcctcaatttcctcatctatcaaatggggataatatgtttactgactacaaattaagtaaaataagacctacaaaactgggtgctactgtatgataacacaacagttactacagatgctattattattaggtcacgtgtgtgaagagaaagtaaaaagaagacaagatgcaaagataaagaaggcaaaatgcaaagatcctatttcaatgaagccaatagtagtctttcaagttgctgttccttcttatttctcttccttccaataataataattcctattgtctaccaagtattgagagcctgtcataggtcagacacatggcatgcattgagagaaagagaattcaaattattctcttgaacttttgagcaactctatcaatgggtcttatttggttccatgttactgctgagtaaaagaacatgctcacagagggtaagaaacctgcccaccagcaccttaccagtagacattagagtcaggactttaaacaggcttttggactccagaaaccatgctctgcctactcaaatttagtagctgttctgaggatctcattctcacttatttccccttttttatttgtttgtttatgttctaaccactgatttgaaacaaattctcagaccagaaatttttactcctgtggaaagagtaattggatgttctcattacaatatttttttcttcatgaatgtaatcaaacatcagctggaagcttgcttttaatgcgtggataaaccagcccacacattttattttccctgaggcgtattgctgggaaaatctatttctgattttaagaaatcaacatatgctgaaccaactgtctattttcatttaaattgacaggagctgagactcaaaaattatgttgtattttccacttctaacattgttgatagaaaagttgaggtaaacactttattctgccttagatgcctgctaaattagtctctctaagtaaaaatgtcaggaggctattgttggattaatttaggtggagttgatacagttttagggaagaaccgttctacagtatgagaacaacttttaatattatgttagttataatctggagcatttatcataccttattatatatcgtatgttttgactttctcctctattgggctgtgggctcaattaagataagaatgtatctcccttatctttgtatatcggtgcttagtgcattgcctggcacatagcaggcgctcaactctgttgaattaaatgatcaatgagttaaactagatggctatatagttgatcttctatatagttgatcttctatattcaaaatatagtttacatatatgtatgcaagtgtatatgtgtgtttatgaataagaagaactatatcttcatactgttgaaaagttatattgtttctcatacagattttattcctttagctaaagttgtatcaatattaaatttataactaaaacgatattacgttggcacatgagggttttagtcagctccagctgctacaacaaaatactataatctggataacttacacaacaacagattaattttctcacaattctggaggctgaaagttctgaaattagggtgccagcatgtttaggttctattgggggccctcttcctggcttgcagtcagtgccttctgacatggtggagaaagagcaagctctctggtgtcttttcttataagagcaccaatcccatcattgcaggccccaccctcatgatctcatcacctcccaaaagacccatctccgaatactattacataaagggttagggcttccacaagtgaattttgaaggggacataattcagtgcatagcaatgagtatcttgtaggcttatgaccatataatttgaagctatgatttatgtagaagttggacaaaaatgtttcacataattagttatgttcacatgatctaatgcctgaaactcatttttaaatatgcctgaaactcatttgttaaaattatagtgttgggaaaagaagcatttaatatttgttagcattgaacttaaaaaaaattaaacacattgactttagagaaatgtatatgttgaagagtaggtgtggatgaaatgaaagaagagagctaacccttctcagtgccagacacagtggtgtgggcattaataattcaaccctcatagcagtccttagggtggtcttaaccatttcatggggaaattgagactcagaagtttactaatttggccaaagtcacataattgtttagagactgattcaaatcaatgtcttctttattccaatcaatcttttagggaccttatctgttatttatatgaaaaaaaacaactaactttaatgtttatggagtttgtttaattaaataaagcccttaggatttcaaattgtttcctaagtccaagagatcccaatgagaaggaacacaaagtaatttttaatgatttaaagtaaatgctttagactgaaatggtagcttctttttaaataacatttcaaattaggtttactattaacatttacaaagaaccagggctataaatcaactttatatgcagtgcattccattgatcttaatagttgtatttgcaagctgagtagaagagatttacagttctctctcaagggatagatctccttttttgggcaatgaatatactccttcagaaagtcctcttgctcttttacgtactcttttttgcttggtatttcaaaggctttttgttatactttaaaaatattcaacaaaaagtcactgaatatctacaatgtgtttatatcttgggtgtaatgcctaggttaataagatgcatagaaatatggacccagtgctacaggcccagcagtgagcaaaactcagggaaacaagtgacactaaacagtgtggagaatgcaaaggctaaaggctatatgagtcctggcatgagcacggaggtatgggctgagcagcgctgcctgaggaggtgatgtacaagtgggtatttatcccccccgggcaaaccagaaggaaaggtaaagccaaggaacaaagtagacaatggagatggtggggaatggagggagaagaggaaagaatcttggagagatagtcagtcttaaggtccaattaaactatttcatggcagccattattatcctgaattttatggatgaagaagtgaggttcaaaaatattacataacttgccctgtgtgacaaaataaatgaaaagcagagccaggttcaatgaaagtatgtttgacttaggttttaaaattctagtcataaatggcaatttaatgttgttatatatttgtattgggcttcagcaaaaacaaaaataaaacctcaagtacacaaaagctctagtaatagagccatgtttgtgcagttatttccagcaatccttggaacctccaaaattctcctcagcctgacattatatgccctatgtgtcatttcattatgtcaccacctggtggtgcactcacacccactttgggagaaagggggttagagaagggaggacatctgtggacaagccaataaaagcatttactggcatcgtgacttcataatttacacttttatttatgcataattaagtataaataaacaaaaacatgtattttctaactgctacctgttctgtttccagtcttgcttgaaaatcatctttctcaaaaaactacctatcatgtgctatgcccattacctgggtgacaaaatgatctgtacacccctacaaaatgcaacttagtcatgtaataaagctgcttatgttccctctaaacctaaaataaaggttggaaaggaaaaaataaataagataaaaattatctttctctatcagagtaatttgacatcttgaggaagtgatcctgggacttcatattctttaggattcaggtgtccagataatcccagaagtagccagcaatttggccatttggggtgtagaaaccttcatacctaggttattgtaatacctcaggctattctctccaggtttccagtgattaattagctgtgaacctcaaccaacacctgactctagaagagtcttcaaataggtcctagaaggaccaagtaaaatcaccatccctcaatccctcaatttttcctttttccaagtcaagaataaaagaagtctgggaaacattgccaggtcagcttctttttaagctcatgattttctgctacctgagggaaggagagaaggaaaaagaaaagaaaagaaaacctcaatgaatgctccataacctggattttaatctctctttccctttttgggataaaattgtttaatgtaattaactacaaggagaaaagttaaccagtggcttctgcttttgctgaaagcactttttcaaacccagctgtcatgtcaaatgcattcaatattagtttggacaactccttacgtgggtctcagaatgcatctctaaagaaagtgtttaaatattttttaatgtgaaaacccatatgggtattttggtgataggatttcttctatgattcaggaataaagtataatgcccaaataggcccttgccattcctatcagggacattgcatccataatccattttccatatccgtttgtatgtaaatgaaaagtctcacacatcacaacttctgtttttctcattgtaggatcgcctcatctgtatttatccacattagtaaaaattatccaaatcccagaaatataacaatagtccgtatttcttgagcatttactctgttctaggctctgtgttaaatgctttgcatgtaatgtctcatttagttttaccacattctatgaggtatttactctccttttcttatatgggtaagaaaacatgttgagttattcaggtaatttgcctatattcacatactggtcatgagaaaactagaggacccaggagattgaagcccatatttcatcatttgactgtcctaggaaacgccttgtatacttgtttttttaaggtattctgtcacccaagaacattgaaggtatatgcagattctcttttcctgttctattccactagacctgaatatgagggatgaaaattgctttggttttgatgtgacttcagtaccttctgtatttgacacagaggtgagtcacatcctgatcagtgttgaaagcatttagtaagattattagtttataaagaaggctgaaccatgactatataataatgaagcaattgtaaaaaaatcagaaagcattcacattcattccttgaatttccaaaagcattcaacaacagaaaaagggcaaacacgtttattccatgtatatatactgaattcctactatgcaccttcaacaataaaggcttttggtatataggagtatactgagcccagttagattcaagtgaaattcctagtaatgtcctggtatacaaggagcttaaatgttcaacatataacattgtttcttatgataggtttcacctataagccctctaaactgtttgtaactctataagaaataattaataaaccccaacaaggtctatttaatgtcttgagacagatcattctactcactttagatttcttatagataataaccagcacctaaaacaatttttaaagacataggaaatccagaataaatataactatcataggaacatggaaagaattaaagaaatggcagaagttgggaaaaaaactactggaggaaaagggtgaaaatgtgtgacaatgaagatttgcaaaggttctagaatactttaaattaagttagaataaacttttagttgcactgtgctttgactttttattcagcctaaattgtccttttaaattcaggttgttcatctccaaggatgaatgtaatttaactgaatcttgtattagagacttgcacatttctcactcattaatatgatcaaaagcatcttatttatgtcaaaagacgagaaacgaaggccatttttggcattgtcctaaagttgtgctttcttgccttattagcatttcatttcaagcaatagattgaacagaaatgcttgtgattgaatgaagattaattatagggtatgggaatattcaaacctttttaattgttctgagtagtgtcttctgctgttttgttatccaaaagggagtaagtatttggggaacaaagattgtgacacatctggtaatattcaagatgcacaccccctcactagactgtcaaaaggctgggcttgtcacagatgtcgaggctgtgatgtattgtcactcttgctgcacccatggatgcgcctctcctgatatgcgactcccattgggaatgtgaagacacagaggagatttttaatcaagagcataggtaggagtcaatgatgcatagctggcagatgcagatttcagcctgggaatatttagaataatttggattgctttatagtttatagtagcatcttttatgcaggactctgacctaattatttcaaaaattattgctactgattataatctcattgttgctttcttttatctattcattgtttaaacagcatttttagggggcagggtagggagaagcagtgtagcttggtaataaagggcatatgatctggacccagcctaccttggaaaatgattaagccccaattttcctatatgtaaaatggagacaatactagcatctacctcacaatattgttgattgaatgaaatgagataatataagtaaattacttccagtagtccctagcacataagcactcattaaatgttagcttttaaaattgtattccagattaacatgcctaaaaactagggctacgtactgagaattcatagaaccaattttactttgtgtctgtgttcttatgcctgcatcaggcattacgaagaatacagagagacaaactttctattcctcagggttgacaatagaagagaaataataatacacaggaaataagtaaaagtataattcaaactccaagtttaatgatgtataaaatgaagaggtcagtttgggctataacaatcagataagattcactaggtgctaaactcgatctaaactgagaaaaatagacaagacttataaatattagtttaaaacataaatctgaaagtgttactcccctatattttagtaagacttctctgtggcccttgctcctataacagtttctttaaggttaaaactgctgggtttctgagctcttctccatcctactaaatgagaacctctaatacaagaggacagtgcttggaaatctacatttgtatagaacccaagtgattcttatcaagcaaataatggaaattctatcttagagaagtctaaacatactaaggcccttgtttagactctatgtaatttcattttcagccactctgggccttgacccctgagaaccagcaaaagagaactttcttcagcacttggcttagccctcccctcttttgtgaaggagtttcccttcactggtcagtgttccttgtctttaatgatggtcttgaacaccactatgttgttgtacttaaaacacagagttgtaactgtttacaggtttatatccattaaaccacttgatcttgtgtttcatgctctcttattctcaccttagcatttagttaccactcactaaatcagttgatcttgaaactttagaaatcttacccttacctgaggggtccttgtttacaaagcagatttctagatgctcttgctcaggtactcttattctgtagttgaaatgggcattttagggccagacactttggctcatacctataataccaacactttgggaagctaaggcaggaagatcacttgagtccaggagttcaagacaggcctgggcagcatagcaagaccctctctctacataattagcctggcatgatagcacatacctggctactcaggagactgaggtgggaggattgcttgaacccagcattttaaggctgcagcgggccacaatcatgccactgcactccagcctgggcaacagagcaagatcccatctcttaaaaaaagtgagcattttaacaagtgtgtaaatagtctaccattctcttaaaacacacacaaacatacacaccttgaaaatgcaaatgaatgaatgtgtgacagagtggaagaaacagcttcagaagggagaataaacatagcatttacagaagatagtgagaataccactgatttggtatgttggatgctggttgggagaattttatgggaaaaataccagttgagtgaaattatggatgttcttgagaaatagcagagtttgaattgaatgtggctttttgcataaagtggtaattttggaattttggaataggagaatgaataaagatggcatccccaatagttgtcatggctagtcttaggaagggttggatcagatgatctctaaaatatctcttaacactgaaatgtatagtgttatgctataaaatatgtagatattgagttgtattaataaagccttagcttgtattcatgggataaaacttctacttaaataatattgtaatttcattcattaatgcatgtgtataaaagtggatcagtattgtggaaggtttgcttaaggtgagatacatgcaatggtagcctggagccaggtagtagtaccagctcaggagtactaactgttacgtattcaatgattttgagacctggttggaaagcacaggcattattaaattatataaacccgtaattaaataaattatatgaaatgcaaaggtaatcaatactcaaaactcattagttcccaagtacttcattatattttactattatccatgctcttgaggttatgtagtccatcgtatctgtgtcgtggaaatactatataatgaggtgcagctacaaatctcttcccaactccacattcagggccatcacattggtagcttgaaataagacatgctgatagtagttacaccatggaaatggacatactgcacaaatcaggcctttttttttctcctggagagccaactgataaatatttaccagcataccaatggctcatgtttagaatagtcccattgttttggggtagaaattcattttggtacatggcctgactcaaaagttcacccctttagtgttacctcctgttcagcattgaagccacttatgtctccttatatgaaaccagaaacaagaggctttttttttttttaattctaagagtggctggctttagttgtaacagaagagagcaggtacctttattgtacttcaatttaaactcctttcaaaaggatctgagaactttttcaaaaaaaatttattcccccaaatctgataaatatgcctctattttacaatcttttacaacttttcaaattactacaatctgaaagacattttcaatctttcttgaaagacagggagaatattgccatggatgaagaaaacaatgacttgtttctttcattgtataaaatcattcttcatcactgtgaaaataagaaaatgaattttttttagttgagcacaatctcgagatctttctaacagcctctgttcttacagtatggatgttactcttggtttatagctctgcaaaggagtcaaagaatcttccttttatgagggccctgaagaaagaaaattgtgctgataaaattactttatgtgcgtttgaatgatgatatggccaagcattcttcagaaacttctgaatttttcatgtatgccttcaagagttgtaatccttacttaagcaaatgtctgtttaggagagattccagagattttcctatttagagtgttttaaaaattaaggaaggtgttcaccagcttactagaggttccttgtgaaaagagaaatgagttttcttcaacagtcttatgtctttggttcaagctgacataattaaggtgtaaacatatcagtatagtttgttttgattaaactttagatggacatagaataggtaatcaaattcattggatcgaaataagtattcttactctgaaatgaaacaaaatggaatcttcagaaacatggaaacaatgacccaaacatcagagaggcattgaagataaatgggaatatcactgggaatagtgtaattggagcagtgttttccaagcccaatcctcagacctctcgaaaatggagattgtaacactagattgtgggcagtctataccaaaccaacagtactgaatcagagtgggttatgggaatggctagagcatttgcaattttacagcatattcagaagatttttatgtacactgaagttgagacgtgctgatttagcaaaggtaactgacaatttgcctcaattccctcatctgcaaaatggggattataaaagtagggttgttggaggactgaatgagtacatatatgtatagtgtttaggacaatgtctgctgttttacagtaagtgctctattgttggctcttgccactattattgttttgtcaagggcttgtctgtgctagctggaatggaaacttaaatgtttctaattattgcaactgtcagatttcttaaatatcgtaatgaagccagcacagtgaagagctgtcctcagtttaatgtaacattggatctatcctaataatttttcttagtttcctattgcatttgtaactattttatttaaatgttttatttttccacagggttacatttattttattacttcagaaatattagatgtcattctgaaattgtggctgtgcctttatcttgcatgtggaattcaattttttatattctttacaaacagtatttataagaaataaagataaggttacagtgagttgttgtatgagatggtaatttacatggggtgctccatatgcttagcttttctctgaagttatgcatccccacagcaagggaaatatttgcatttctgagagtgagaatttatgttcatcctctactaggaatggtggcagcttttccaggtcaaggccctgcagatgcctgatggtcatggtaaatgaaggctggatgcagggaaggcagcaaaatgagaaaatctcctgggatcaattaatgggagtcatctgagagagaataaaggcaggagaacattttcttctagtcaggaattcgcatcagttttgcctggtaatgggtttcatgaaagccaagatgaaagggttttatccctaaggaaaaaagggctctcctcacatcctctttctgtgctcttttatcaatgactaataataacatgcttgcatccatgacaatctttcagaaaactgatgcaaaaacaagtccaaaattagagtgtacagctgtcgtgatttcctggagtttctggtgtgtgcttagtaggcacacagtttgagttacatggcttcattatatgattacacactactttgttgcctcattggtggttaaggtgattttaaacttttcagtacccaaaagcagtgtcctggaacataccaatgaagacggagaattgtttcagtcccagagatatcccaagcaaatacagcagtgaactcaatggatatttgtgaaatgaataaataaatgaatgaatgagtactactgtgaatattcttgtcatgtttgcttgttctcatttggagagtttctttgaggtccgtgaccagaggttgaattgctggatcttaaagtaagaggattaccaacttccctatacgatgctcaattcctctccacaatggctatactagtttactgtctggcaatcggtgtatgagggttacctgtttatcacattgttgtaacatttgattttgtcagatgtcaggttctaactgaggtccaaggggagttggtgggcaagtggcgggtagctggaaaaacacgtgaggaactgtagacagtttcaacatggatttactctctctctggccatgagccatgagcgcaagatgtatgtacagcgtcagcagcgtagttgtaccttttacagacaatagtggctccaagccaagcacaagcttacatgggtgatcacctaatgtgcctcacgtggcgtggttacataatgtgcagagttgtgagcctgtgctccaaactcactgagtcatgctggaccggatgtctgcttcggcctatttttgagagcagcacatccattttccttacactccaccctcaatgccaaaggagacacaggccttggacacacaggtctaagacacaggccttatacgtacactctggggacaaaggccctggacacacaggtctgacacataggccttaaattctactccctaggctgaaggagtcttttaaatggagaaacatgcccacagggtggaaccccagacccagaggccacagcagtaatacaaggagcaacaactccaggttatgacgggcaaacaccccatgatgatgttacccgaatttactttatgcattaagccaggtttttatttccctacctttaggggcattggggcatgcaacaacaggttaccatccgtttccatcctggtcataggaggtcatccttcctcccataggtcttgccacatggcctagccccacatgggccagtggccaactagccacttctgtattttccaggtgcctaaccacaaggttaagcctcgatagaccacacagctattggtgcagattatcatatgtgtcacctctttggtgatcaccattcatattgctctgacttcagcccattgactactttgtccatacccggtatgaaaccatatggagtcagtactaggctggactgtgagcagtccaggcagtagcagcaccccagctagacccatctgtgtaccgtgccccatcgggcatagggggggatgcccttccttaaatggtgaaggctcagcatgtaggggtgcttcaggccccatgtccttaggccccatggccttatcttgcattaggactgctggtctcaagacctcttgcaactctgctgctaagggacttgtactcagcgtactctgttgcttcaagtaggtgccccactttgctaaagtggatgtctgcactgtcccagtccggggggttgttatcaatgaacacatccatcctgctatcaggtaactcgtctacacgacaactgtagcctgtcctgccatgctctcatgagcccgaagggcagcatatgcagttactaactgcttctctatcagtgaatactggagctcagcttctttccatagttgggaccaaaagcctactggtgttctcaagcactccatgctctgccacaggccccagccaaaaccatctgtggtcacatgcacatccaactcaaatgagcacccttggtcaactacccatagggcttgtgcctgctgaatagcctatttagctgccaggaagtcagtctcagccacactatcttaattctaggcaagaggagcattgccgcttctaaatctgcaagagaatcagaggttaacataatattatcaataagaccatgacatatgatggggctatgcatatatccctgcagcaacactatgaaagtccactgtcaccttcccgtgaaggcgaactgttcctggctctctagagcaatgttaattgaaaatgcattaatcaagtccaccacatagtggcactgtccaaattccatcatcaagcggtccatcaaatctgtaatagatgggatggctgtcaggccatgtaaaacatccacccccagaatatatcagcgctggtgtttaccagtgccagcacttgctgtatgttggtggaggaccagtggattgctaatttcacatgtggcctctatttgtctggtgtccccccaggccaggcacctcagccagttccctaatcaaacagaaaaagctcaacatttccacctggctgcagcaagtagtctttgagttgaagcacctgagtgggaccaggtcatacagcaatgtcctccttccccttctgcatttcctggaattgctgctcttgagacagttatctccacaaagttaagagtacttcattgggctgcttatcgattttctctcagtcaaccctggccaaagtcaaatctatccacatctgtgagtgggtcacttgttggggcccccttttcttccatgatggggaggctctgcaggtggggcatcttccccttttttacagtgcagacccagaccaagcaggggtctctggctgagatgacggacccaggcctgcattcacaacagcctctaactccctttccaaccctatgccaggccttcaggcaccccacctgcacctggagatccccattcatggcagcctctaactctttttctaagctgtgtagctgggcctccaggcaccctgcctgtgcccaaaaggccctttcctgcactgcatccctcagggattgggagtgtacttcttgtagcacagaaaaaatgcccatccaactctgctgtcaaaggctcattccttctcggtgctctgcacttccagctgcttcagtgctttctccgtgctcgtggggtacccatctactgctggccaggtttccaacagagttcacccttgcagcacagctgtgaccaggtaccacaacccatgtcgtggccacattgccaacccagaatcagcagggaccaaaggctcgcccaccttgggatcctgttcgtgatgccaattgtcaggttctaactgaggtctgaggggagtcagtgggtgagtggtgggtagctggaaaaacactagaggaatcatgcacagtttcaacgtgcctttactgtctgagtgtgagccgtaggtgcaaaccataggtacagtgtcagtccggtagttataccttttacagacaatagtggctctgagccagttacaagctcatgtgggtgatcacctaatgcgccttacgtggtgtagttacataatgtgcagaattgtgcacctgcactccaaacttgctgagtcatgctggacctgatgtctgcctcagcctattgactgcagcgcatacattttccttaaatcagatttttaaaatttttgcctgtcagatgaggtatgtctgtcactattgttttaattattttttcctaattgctagcaaagttgcctatcttctcaaatgttcacttattgttttttttcctgtgagttcttgcatccagtttgaacagtactatttaactttgttttaatgctgtcaaattcctaaaatagttgcttatgtcacagaagttctaacctcagaatgatgatatccatgccaaagcagttgaaatttaaattcttagataagtaactttaaatattccagtgttatagtaaaacatttatactggactattcactcaaaaattctttaaacagttgtcaaccttatttatttcattataataattgtaactttaaatgtgagatatgataaccacatctctgaaatgtgacaaccttgtccaccaatgttattatgcctgaaacataaatcttgggcccctgctcagaacctttgccttctagtttcagtaattatgaaattaattttgtgtttggtgttttgcaaattaaacttaccctattaaccctatagcgtatatacattatagatatattattataattattatatttttaaaaatagctttatgctcattgggcagaatctgtatcagcacattttttggcagaatagattcagtagactaataactctgttataaatccctggtagcaatgttgggtaaattcagtggactaataaatctgttataaatccctggtaacaatggtggggttttaatgagtaacataaagaacttagaataaaacaacttaaatatatatatatatatatatatatatatatatatatgaataatattaacctttattcttatatttgtataatgtagttatctgatttgcagagggagagaaagagacagacaaatggatagacagacagaacgagatcatttagaccataaggttagaaaaatattatgagactatggaaaggtaatgaatatggtagagagagatggagctgaagattataattctttacttatggactgctctaggataactttgtttgatgttattttagccttctgatatcagtttatatactctaaaacgagtagaaaagaagcatcagtttgtataaatattctatttaaatattgtcaaagcaggtccatgcatcagaagtcaaattaaaactcactggggaaaactttgaaaaggcctgaaggaaatgtacttgatttttataatgtaattggcaaaggaaattgtagtcaaatatgagagctaatgaaagagtgaatggataagtaaaatccacaaataagcacaaatgtcattgggctgtttccctttccttaccaaagaaaatttcatgagagttgctaatgaataagatctgaacattatataacctttataagcattttcctcaaccatttttttctggttgagatgtcaacaagaagtaatatatcataatatacaaaagaagatgcatagtgtattaataatatgctaccaattaaaaatcgctggaataatttggcattggaaatgatgaaggcataaagagcagatcttgtattagacaaaaactaggaagttatagttaggttgtagtaaatgatgaacaatccattttgattgtgattcccaactagcttttaggcagagcctcaaccacagaaactcaatcctagtggataaaaaatatgcagacaatttgaagggagtgaagagagcagaagaaagtatgatgaaagaattgaaagattatgcaacagaggagtatttacagcctggctagataaatgaatggatatattattttttttaatttttttagctaatttacattgttaatttttatttaactattatttttaaaagaagataaatactgcagtggaaagagacttaagggattatactaagggcaattatgagaactcttgggacaaaataatggtcttatatcaacaaaaattccctggaagtgtgatatgtcagcttgcagaaaattttcccaatgtagtgataagaattctctgaagacataggcagattgaaaagacatgaataagaaacaatgtgagatacatttccatacttactgcagaggtaaagcagaatggaatttgtatcttttcctctgcaggtcctattagagaagacaatagagaaccctctaagaggtgattgtcaaattggttaatatgctgtggtttggagtgcctgcattgtgaacaagggcacattcattcaactttccacatcttcctttccctgtaaaatgtacatggagttatggtaccttattaggctattgttagtatcacatataaaaccatgtaaaattcctaccgtatgcctggttcagtcagtgctcctcaggtggtagctattggttaaccctattctttataacataattgaaattaggttatatgacttttaaatatccaaacagtcagaatagaaatattgatgagaaattttgcttcatctcaaaaacagtgttagaactacaccaatggagtatttttctcctaaaaggttaatcaggatatgacatttataggatttacaatcacaatcctgataactgtgaaatataatatcagactgtttcttactattttatttttaacattgacattaagttaaataatatattttgttactgtagcctaggattttattttccctgttatgagaacaaggataattattttacaaatgaaattttaagggattagagtgccatagacatgctcattgcattattaatgtgcagaatactggagttctgccatcttcatgaatccccacattacattttggataaagaataagttctgtatataaatgtaggcttcagaagcttttgttgattctttcaccatattttatacaaaggctttcttgctttcctgcctctcatgctaagtacaggcccttcctgtactttcggctaaacgagatggcctttcatgtataaaactcagctgaaaaattgacttcttcataaaaccattcctgtttcatccctgactcaaggtcctgacttgaattcttccgacttccctgggcactgagccagcatagttctggttcgttgtataattgtttatatccttgtagcatattcagatgcacatagtcaccatgtctcacccagaatcagaatctctcaaggaaagaaagcatgtcctctctttccctaataatccccaaagctctcaataccatgctgtgcccacagaagggaatcagttaaatctgctgcaattgattggaaacttcttttcccccagattttccttaggtggtctcctgcagagttctgtctaaagtaatggagacttgggatttgtattctcattatgctaatggttattacttcctttatttttgaaaactggttgtaggatctaagctaaccatgctattttctgcataccacccagcgattctcatttagcaactgccttcaaatcgtctactccctttggtctcctcctcccctcagtaggagaaggatgagaggaagttggaatatttacactgagatgagatccttgagcacttgagccctgaggctgcctctggactaacgtttctgttcagctgtccccaggtttttcaacaagagctgtcagaaacaagtttgtgactaaagagcagcttcatctgtaacttctgtttcttgctactccctgctgtgtttctggctatctggaagcttctcagcagggtagcaagttgttggcgccactaacacctttcctctttcaaattcatattcttccttgggaggtgagtttgcatttcagaaaattctattttagtgaaaccacccaggaatcagtgtcagttggctttcagctgtgaaataactgcagagactttgttacagctaagggggtgcgattcttttggagagtttagattttctgtttatagagaagagttcttaggaattttatgcttagctgaaagtattaaacacttttccttatttcctcaacatgaattctttttcccggggctgcaggggaaagggctctgatcctggttcagtctctagcttgatcattttagtcgagttcctttacttccatgcaactctgtttcctcaagtataaaactattagttgagtgggtagaagaagtagatgatctttaaagcactttttaagtctaaaatgttatgattctgctatcaaattcacagcttctcaacatcagataagggttggcatgagtgttgctgaaaatatatttgggttggaggaagggatatcctcgattaaaaaaaaaaaaaaagccagatgagaaattaagacttttcagccaatgctattgacataaactcagggtgactttcacgtcctaagtagaagtggaacgttcattaattaaagcttaggtaatacctctttatcaaaattaataatttatgttcaaattaatcatcatgaattgacatagctaatttgacccttcatggttatcagagtctttttggtgaatatcatagtctacattaattgaaagaggataaggtacataggtgtcctctcccacaactaagccatcatgtctaatgtagtaatgaaagcagattttggactgaattttgttgactggcaagcttttgttaccaaggagccacaactatcataaagcctattctcataagctccatagactcccagctttctgtcccttagacattgtgataagcgtcttacatggaagatcattttttattatgtctgtttgattcttctctctttcttccttattagtctagctagtagtctatctattaattttttcaaaaaatcagctcctgtattccttgatttttcaaagggcttttcatgtctatctccttcagttctgttctggatcttgtcttctactagctgtggggtttgtttgagaggacatgaacagacacttctcaaaagaagacattcatgcagccaacaaacatgaaaaaaaagctcaacatcactgatcatttgagaaatgcaaatcaaaaccacaatgagataccatctcacaccagtcagaatggccattattaaatagtcaagaaacaacagatgctggtgaggttgtggagaagtaggaacgcttttacactgctggtgggaatgtaaattagttcaaccattatggaagactgtatggcgattcctcaaagatctagaaccagaaataggatttgacccaacaatcacattactgagtatatactcaaaggaatataaatcattctgttacaaagatacatacacaggtatgttcattacagcactattcacaatagcaaggcatggaatcaacccaaatgcccatcaatgatagactggttgaagaaaatgtggtacatacacaccatgggataccatgcagccataaaaaggaatgagataatgtcctttgcagggacgtggatgaatgttctcacttataaatgggagctgaacaatgagatcacatggacacagggaggggaacaacacacactggggcctgtcagggagtggggtttagtgagggaaagtattaggaaaagtagctaatgcatgctggtcttaatacctaggtgatgggttgataggttcagcaaccactgtggcacacatctacctatgtaacaaacctgtgcatcccgtgcatgtaccccagaaccaaaaacaaaaaaaataaaaacctaaaaaaaatcttatttcaaaaacaggctatgggctagatgtggcctgagggccatagtttgttaaggcctgggactagaccaacatatgcatgtgaccatcttgtggatgagtttccacaagactgagagctccataaaggcagagactgtattttctcattttttattcccctcagtgccaagaaaaacagtaattcaataaatgtttgttgcattaaagaatttattcacgaagagttataaaaatcaatccactgtttttccatttgctatctctgaacatgtactatgtcatttttacttgaagatatttatattgaaatctctggttagtgatgtctcacttctgtgtacagctaagaagacgtacagtttttaaaataatgttactaactgtaacaaaaactattttatcaagaaatataaaagaaattctttaacaaggttgagaggttacttcatgcattaagtttctgctatcttgctgatgttctgctataaaaccttacagacactatgtctgtattactggtttcatttgaaattttgccttatgattaatctaatttggtttcattgtccataataaaaagcaattgagcatcactgatgtggataccattttctttaggttttaagaaaaccactctaatattttttcagggccattattttatcaaatatgtatatatgtgtgcataaggagaaggagctcggaaaaggatttatatttccttatagtcaattttatgttctttctaccctaccactagctccaccatattgaaaatatctctataaatatgggttatgtcctataagcaaaggatacattctagaattcatttctctctaaaccatgaagcatcatccttaagcaagatgctaaacctgaaacctctgtagagcacatttgggtagacttatgttctcattcttgcctagaagagagatatttctagttttcttatttgctaaccttataatttgagcacagaatgtcagatttgtttcagcccttcgatttaatcacatcatgtctgatatcctagcatttaattacccaaattcccagtgttgttcaagaaggtaggtctgtggtgggttagccttaagctagtggctgaaaaggtcttgatttgcccccacatctaacctagtcacttcctgagctgaaactcccatatcacctggggacaagcgaccctgaaatcctcactggccacagcttcttctgagggaagctgcaggaaaaagaacaaaaatgagcttttgtgaaaggattaacttgggtgaagaacatcctccataaccaaataaatggaacctagtaacccacatggccaatccccagggcactagtgtctttggggatatcagggtgtgtatagaatttcgtttttgtcattcttgaaaacataaaaaaatctctgaaagagtactagtggtcaaggtactagtctagagatggaccaaacaatcatattaaacctaatttaatctccagaatttatattttgagattggtagcactactatcttcattttgtactttccccaacttcctgcagctaggattcaaatacagaccatctaactccagagcactgccctttaacattgtgctataatccaccactttgcatagttgatcctacaagaggataagtagagatcaaagtaagaagtgatcaatggattactatgtcaagcatgattccctcaaactattgggaagaataaataccataacatgtatagggtgctgtgtacaattcctggcacaaagttaagtacatgataaaatggaactattaatattagtaacccagataggttctgggcacattagcaggaaaggtcttcttaatttaagtaaggtgctaaaagcatctaattttattaggattgttatgaaacaaaaactaaatgtgcaagaaaatatatttaccgtagcctggggaaaattgtcatggtttctcttttcaaagaattcaatttggtaagaaacagccttcaatggtccatgaaaagtgagaagtgtagggaataagaggctctttcctatgtttgcatttcaggcttgccttcttacttttaaatttatctttacaattgccttcctgctgggtttgtgtcttcctcagtttagggaaggtgacaagaaaagtcctgtttgtgtgtaattgacatgaaaaatggtaggcttttaactcaaggaggctccagacaacagtttggttattaaggaaggggaggacctaggggaacaattgtttctggcctctcttcttctcaggcctggaacaatctttcatttactatattcttgccacaagagcacagtcaatattaaattccaaaaaaagaaaaatccctcacagaaacagctgtgttcaatatacagccagtttactctggcgaattgctagacatggaacagttttcatttctttttgtgtttatccctgatagttgtcttgtaaaatctgccttttgtaaataagggaaggctggttttaaacagctttgactaatattggtagttggagtattcagtattacagagttttagagaactaaaataaacctgatggaaacacacacatatttcaaaggaaacattttaaggtgttctggttccattttttccattttgtatgtaagttggattatgatacttttatgtctacattgtctcttagtcaaaaatgtgagagacgccattcaagtctagacttggaccctactgaatgccttgttcatggacaccacacaatctcgatgtaaatgtttattgctgatctgtacaaaaaggggaaaagtagttttttgaacaacagaaaataccagttaatctcactggattcaggaattatagcaaagcaatccaataagtggattctctgagagtaggaactcaagtgtgttatctcagtttttatccagtttccagcacaatgctggcaccatttaaattctcagtcaatgctggagaattgaaaaagaatcctcaaaatttggatgacaaaatgacaaaggtgtcccctgatacagaaatctgtccatggcagaaagattagtgatttgagatatggtgtcatcattgtagatgatggtgtcccattaagcatgttttcactaattacaataaatgttgaaagaaggagtttcacctagtatccttactaatatcagggaatggcctgggctttggggagatgagagtcctctgctttcagtttaataaagtaggatatttgtgtttttgtttatattgttaaatacgacgggttagcttgtcacctacataatattgtgtggcataaataaaggtgaattcccaaatatgtgctccatagtgttgacaatgagtaaatgttcattctaataattgtaagggttacctccctcgcactccttgaaatatctttttattcaaatttttcgagctggaggtcatgtgttacatttcctgttgtgtaacatggcctccctctctttctctgtctcactttctcactttctccctctttcttttactctctctgcctctacctctgactccttctccttcttcccagctttgcatcagagccatgtaactgacattttcttggttccctcaggacctgtcataatagcaggcaaatattagatgatgattcaatgtttaatgaatttttcttgaatgtatgtatgttgcttcaagtcattcatgcacacattgaagaggacagacagagccctgctgaacaccactagcaaatctctctctagtagaccacaacaagtcaatctgtgctctttgattacagttgttcaaccagttactaatctaactaattgtaactggttgaacaactgaacccaaagggtgcaaagtagaaacatttcattgtgaagtcggctggggacaaagaaaacaccaccagaacccccttcaatatgcaaagggaaaattccttctcaagtacaagctacatggtgcctttttgaattatcatcaatttgtaatgctgtatcaatacatatgtattatctgttcttttggtaagggttgtttgaagtataaggtacttcctccattaaggtgatactaaccacatgttaattattgtctgaaagtcaccaaggatatgaataataaaaagttttaaaaataagacctgtttcttttattgatagttgtacctcaaggctgaagtgaggtttgcaatgtaagttgtaaaatgtgatgtgaaatagacaattctttgtagtttatataaggcaatatatccatgtgcaattatggtcaaaaacagcagacttttaagtgattattctaaagttatttttttccaaaataactttattactcttgatatcataccatattcacaaaacattctggtaaagctattgctcagtgtgttgtcccagtgagactcagggaacatttctatgtgacgctttaggattgaagacagttccacgttttctgagtaattccaaactgtgtaagagattatgttccctttgcatattggctgctaagaagctcactttttcacttatgatacttggatgcattttggctttttgggtttttgttttttggtctaatttttttttttttttttttttttgagacagggtctcactctgttgcccaggctggagtgcagtggcaccatcatggctcactgcaaccttgacctctcctggctcaggtgatcctcccacctcagcctctcaagtagctggaattacaggcatgtgccacaacacccagctaatttttgtattttttgtagagatgaggtttcgccatgttgcccaggctggtcacaaattcctggactcaagccatcttcctgccttggcctcccaaagtgcgggcattacaggtattagaggtaggagctactgcatctggccatgggaaacattttgaatgataactttgtttgtttgttgtctgttgagcaggctggagtgcagttgcatgatcacggctcactgaactctttcctttaatttttttattctctcagcacgattataatttattttaaaagtagggaataattggccaggcgcagtggctcacacctgtaatcccagcactttgggaggccgaggcaggcagatcacaaggtcaggagatcgagaccatcctggctaatatggtgtgaaaccccgtctctactaaaaaatacaaaaaattagccgggtgtggtggtgggcacctgtagtcccagctgcttgagaggctgaggcaggagaatgacgtgaacctgggagggggagcttgcagtgagcccagattgtgccattgcactccagcctgggcgacagagtgagacttcatctcaaaaaaagaaaagcagggaataattagtaagtgcctaactaatcaaaaattgtttccaggtgatgttgctgttgatgtatgaaaacctctttcacctagcttccctcttcattcttttctgtcatatttctattgaccagtgctttcttggcccttggaaatgtgattaacttttgccatgacctctatgttagtgccacacctgacacctttatgccactctctgcctccagaactctgtgtccatcttatatgtttttaccttctgctgggcctcaggtctggatgcaaagctgtagaggaattgagctgtttttcacaagggatccaagaacacatagcatgtgtgaactgtactaaagctttgagaagttgtgaagaagattcacatcaactatgcaccacacagccttcttgtcttgctggtaccatctcctcacctctgtgttgctcctcttggagtcttcaccttccacaaccagcacttctattctcactgtctgagtgtgactttccataattgtgaaactccttgggcttatccctcacactcattcttgaattctaaggaatggcattttctccattgtgcttacatttgcttttcagtattaattgttctagagaaaagcattcattcactcactcactcattcactcatttaacaaaacctgtatgggtatctacagtactatgttctaggtatactgaagacactaacataaataatacaaataataaccttttctcagggaatttagattaaagtagttcaaattggagcaggggaagcaaatatttacgtagattatcagggaaaatgtgtagtgagtgccgtgattagcactatgcagaagattttatgggagtggcaaaaagcagaacctaaccttttctggggtgaaaagtgtgacctaaactgagtcttaaagaatgaatgtagggtggagagaggaataggaagagcatttcagggagagaggaatagcaggaacagagacactgatgcaaggaatcccatggtatttgtgatgaagggatgatttagtagttcagtgacaagacatgagcctggagataaataaggtttaggttctggggaccttgtgagccaggttaaggactttgggttcatcctcaaaccatgaagcattccaagcaattatgtgacaagatcagattctaggggctgaatggagaataaatatgtaagtggcaagattgaaggctgggaatgtaaaaggtggctcctgctgtggcttgggcaaaacatcacataggcttgagctagctttgtgattctacgggattgagaggagaatgctaatttcataaatgtttagtggatatgattggcatgtgatctgaatgcaactggagaaggggaccagtcatttactgagttgatattggtaattgataaataagaccaaagaaggtgaggtttggggataggcagtgtaaattttggaagtaataaggggattgaggttctgtccatggcattggtggggaaatctagcatgtaaatacatgtaaatagataagtaaatatgcctatacatttatataagatatctatacacttattctccttctttgttcatttattaggtgtgaaatctacgtgatttttttctcccatattatttttggtattcaataaatgtgaatcatgaagagatagctgttttatttaatctctgcaaagtcacattcttacccattttgattgtaataaaaggcctatgtcgttatttaattttttaacctttgtggcatgatttatagaaggaaaataaaagtgtcataggtatgataggccaaagttgggttgttggtaaaataataataccacaaaatgtttttctatttagccaactactgcaaagttactttaattgtgtttgcaattaattgatttcactttaaaccagaaacaatagagactgtaatcacacagccctgcagttctgaatgttttgttcttccttttattggttttctagatattcctagttggcaacaggatagagttcagtaatggttatgcaatttcattgtgcagggtattaaaatttgtgaccagggatcccaggagaccagctattagattttcaatgcactattagattaaatatatctactcaaactaaagggatcctgcctgaggctgtctgatcaatagtctatcattcctgtgcaaatgaagctattaagattctcttaggaggtagactatctaaattggatctaactagtagatggtgactgaaatgagggatatactgatacttaattggcatcaatctgaccttgataagattttgaaaaaataaatacctttttgctacaggttgaaaaagaggtgtaaaatagtccctattttatattattggttcttaagtacttatcagaaaaatgacaaaagtcagtgtccataaacaaaggttccattgatctttgatcaccaaatcatcatttctatcttcctcttttttgtttaggtcactgcagtcaccattacctccaccaccatcataattatatatagctaccacttcttggacactcaggtctgcttgtgtttgaaccagacatttctagctccaaagcctgcattcttaatttcctgcagtcttaataccatctttttaatagaagacccccacaggaaaagctgattctataatttaaaaatgatttggggatccaataagtcatgattctattttatataattttggaagatgtggccagagagctaactctttttattttattatttttcttttaattgttgacgtacttataaccaccagctatgaagctataatttattgccacattgagtatgttaaattgttaatttacataatttctgattcttatttctcccctctcaaattcaatttgataatttaacatacctgcttctgtgtgttccatggaactattaatataattttttaacagaattatgagagaattacatttccccagctgtagatcaattgagaaacagtagaaatgaaaaggttaagaaattctgcttcaaaatctcaaatggtcaaagtcattgacattgtaagctcttctgttcgactcaagcctggtggaaaatgtaatgaagaggtacaaagtacactgcataatccagcaagctaattgcccactttaaggcctcttgagcccaatggccaagtgaaacctccactctcagggaaattaggcaactgctaaggtggttttgcagttttcagagacacagagattaggtttttcagccttatatagatctgtgatcactaatgatagtctgtgctaatgaaggtagttttttgaatcaaatgcatattgacttaggtcttcagcgcagaatgttgattcactgctgtcatccctgtcaagagagctgcatatgtaattatggttttcttttgaatagatttgctttgggactgtcacgcaaattccatttcttcatgttcttgctatctttcaacctcaaataaataaataaatagaaaaaatatctctaagcactatgtgtgggctgtcattctttttacatttagtgttctaatgtttttaaacaagtcagtttacaggtaaagtttgctgtaataggattgaatgtgggtgtatgtggtggtgcttcagatctctttccttctgcttgacccttcatgttgggtaatagttttaaagcgctcatgccagaaagtaaaccacaacatagtcaacttctcaaatatccatgcaatgtagaaagtccggggtcaagatgattactatgtgatctgcttaagtgggaacagggccatttccctcgccttcaacacactcagatacatctcagccaaccaacattttgctgtttgaaaaacatggcagactttatcttgtccctaaagagaatgcttttctccatccctctgcttaatatcctgtggctccatttaacctccaagccaaagtccagtttcttttagaagacttcaggcaaaattaggagcctcttatagtgggatgaatgctttctatactgtttttgtaatatttttgtaacatttgccatattaaactccatttattttatgggtctgaatcttcactagactaaactgcttgagagaggagcatgtataattcattttcatgttcacaatgctgaaactgatgtctatagagcttcagtatttgtccactgcataaaatcagtaaataaaggcaggaaagtttgttacatcaagtaggaccaagggctagatccattgggacaattcaacagggcttttcattggttattctagctgatatcaacctgccctgacctgaatcaactctgagcccctacctaggctgttgtttcttagcaagtacataataacaactcatcagaatagcagagatcttggtaacaggttgcctgacacttgactgatatgggaaaatcctgaacaggtttggactggaatcttggctcacaacctgtgtgaccttggtcaagatattttatctctctgagcctcaattttctcttctgttaaatgagcatagtgaaactttgttcattggtttgctttgaagagtaaatgagatggtaagtgttggtgtatgtagtgcaggaacataacaattcttgatagatattcattgaatacctgtagtacatagaacatagaaagttcctgttattccactcccacccccacacacttgcccttcaggtctcaggttctccttcctggtacccccagaaagattaagcccctttggccctctatgtgcctcttttatagcatttaacacaattataattaattgattatgtaacttttttatttaatagctgtctcttgtagaatataagcacataaattcagggactatctattaatgaattttcctctagtgcctagtacttaggtggctcacagtaaatgctgattcaatggatgaataactttattcagtctgctcagtgtggcctttaatttagattcaccccaaattactccccatcaggaaggctttcttattcaactttctcatcctcaagattagcaaaactactctctttctattcccaaatatcttctctcagtttcattaccatgatcagaaagtactcttccttgaatttattttctagactagatctattttggggttttcttaccagtgattgtaactattgatgtggtcttttttctgttttttacttctcatatgtgtatctctttccattagtccttcattccttcaacagatactttctgttgtgacagccactcttctaagcactatggaaggatttaaagctgtgtgaagcacagttattccggtcaaggaacttaaaaaaataatacaagtgacaaaacatgtgcaagtttgactaaagtatgagactggaataaataccttataaaaaccaagagcttcagtattttcctgcagttttttgctctattgtattctcaacttttactggtttctcatcaaataaatgtgttaaagtataactcagatcattgcttagatgtacttacttttccaacaaggccttccctgaacatcctatttaccattgcaaatgcattcctctccactagcgccattcttaccctctctttccacatcaatgaatttcatagcacttgtcactttttttcatgctgtataatgtatattaagatattgcttattgtctgtctcccttcaatagaatgtaagctccatgtgggccaggatgtgtagtcattgatgtatccctagaataagtgcccaattatagtagtcatttgatggacatttattaaatgaaattatgaatgaagtagggattggcagttatacactaagactctggaaaaatggcctgagttgaatcctggctttaccattcttggctatataatctcatattatttactttcagcctttcatttcccagatgcccctaccttctagggttgttgggaggatggaatgcataatacatgtaaaccagcaagttcatagtaacaaaagttgactttttaaaaagttaacttactcttctttcctatatatgtgtaaatcatattttattttctcattttaaaaagaagacaataactaaaggtattagcacataatgattcaaaacataatatttccacatgtcgagttgaatgactttgagccagataatatgagttgaaatcagtttaacaataattaaatcagccaagagcagtgtctcatgcctgtaatctcagcactttgggaggctgaggcaggtggatcacttgagctcaggagtttgagaccagcctgagcaacgtggtgaaaccccatctctacaaaaaatacaacaacaaaaaattagccaggtgtggtggctcatgtctgtagtcccagctacttggggggctgaggcaggaggatcacttgagcccaggaggtcaaggctgcagcgaactgtgtttgtaccactgcacttcagcctggacgacacagaccatgtctcaaaaagaaaaaaaatagaataaaatcaaatacacaccatttttgaatatgtcaccagtctgtgtagttcatcttgaaaggacttcaaggtccaatatgcatcatgcagagagttgctagggcccagacaagagtgacttgaccattggcctgagtagttaaactatcagataactagtgaaacaattcggctatttcaacaaacatgttgcatacataacgtgttatgcacagagatgacatttggtataatattatggcaataaaaggtgcagttcctgccttggggaagcaattgtaatatactgtgaggagctaagagtaaagaaggggcccttgtaaatgaggggtgggtcagtagggtagcagttggcagaagactcacactggaataaatgctccttgactcgatattttttttttttcaaaaatgcagaagcattattgaagcccggatgtttgggttctatgataaataaaagatatggatttgagctgctcattaaattttgaaagaaaagatcctaaaaggttagagaccatggagatttcaaagtggctgaccttgattagatataagtgtaagtcagatgggtattcctggggggtcccgactttaatacaatttgaaagtttcatgattatgagcacctctctgtgcctccttggtggagagctgacctatgagtagttactgtgtgaattaatgaacatccttcagcaaaagttattaatagtaatgtttggtaaaagtcctttagaagtagactgttatgtgtgttactagttataatcaattaataacctgtgatttgtaggagcaaatggtcatagggatacagtatacattttaatcttgctcttcaaacatcaccgtagatccatggtccttctcaagacattggctttgttctgaagcagctcccacgctcttccagaaatctctatgcgggactctgaatgtggtcaagaagaagatgtactggatgcacattccctatcaggagtctcttaatagtctcccacccagttacaacatattgctgtaatcccacacaacagctgaaacatcttttcttcatttcttttaattcctgtagcatttgatgtctccaccgtgtaatttacatttaattgtaagttgttttgcatcatttaatagttgtttcaagtatgaatgtcttgccttcccaagaagattaaaataagattcctttaagaacagaggctcactgcgcagtgccagacatagacatagagtaaaccacaactactgacttcacttcaagctgacctaaccatcttcccagcgaagacggccaacctggtgtataactcattcttctgatctgcacttactttatagaggaataaatacactgagttattgggagtttgtgaaggaagtgactagaatttcaataaaataataaagttttgttttgtttcatttcgtttgaaaagaaactgctgcatggccaagatatttgaaaatggaggctgggattggacaggggtgaagaattgtgtcacagactttgtactggaaaaatgtctgccttaatctagtgaataaatatgactgttctttgaagtcctttttttcctccccgagtataaattcaaatgctattcattttctgagttgcctgtatttctttagcccttaaggcatcaacctttgatgtcttattttcataatattttctctcttagaactgatccacatattcagtagaatggaggtataaatcctaatccatagactactccgagcttattgaaagtgaatcttatttagattctttcctttatctgctcactgacagatctaatgttaaacagaaccttattatcatcacaaggaagtagattaaaaaatacttttcagtcattcgtattcaacaagtacactccatcaaatcttgcctaactttttttgcaaataactttgctccttggatcctctcccaggtctttatcaaaatggaaccacatacatttgtaactacctcataattaaagttttgagtcattaagttcagttatctttaagggtaaacattgaatttgctgtaaaagttccatttgtttcactaaaattcgcaaatagttgtgattttctttgcagatctgtccagtttgatcttgaaacaaaactgcttaaaactttatcagccttccttctttttggcttagctttaataaccacttttaatatataactcagatctataaataatactgagaaaagcagtggaaaacattgcaggtataaagacttttcatgttgactatttttggtaaagattctggacatttgagtgaagtctctcatgttttattggtttattttactctggcaccgcttatgaaaaaggggacttgaattactagagggtaattttctttctttattttatttatatattttttactatttttttccttcagttatgttgtttattcaaaacttgaaaacatatacaatttcagggtcttctagagtatatttacatcattctgatgaacaactttataatttttaaattagcaaatattctcaaccctgtcagctttaatattataattaatgtgcacaaatctgaaaacttttcttgctcatactataatacattaaatagaccttagcaaacaacttcttatttgaatacttgtctgtccctgtcactcttctcatactttagcctcataactttggttataattatgtaaatggttaatattcatgttctcattgcaaaatgaaaagtgaggaagagaaattaagccatttgcctaaggtcacaagtctggtaaaatcaacagaggcactcagaatacctccaaaatcatttccatgatgccagaacctttaaatgctacagaaacaagctaaagcgatgcatttaaatgtgcttctatgtagggcttgagctgtatctaaacttaaattagagctcagccaacatagaatctagttcagcaatactctacaacatgagataaccatactgatgtttgatataaaatgagattgcagaggaaacacattttaatacctgaggtgtgtgcttaatcttcttgatgtatattaaaagctcagtacgtgagagtaatatgaggtgatggggtttactcttaaagagattactaataatgtttatttggaaaaagatgaagattttagaggctatttaagaaactggttctgggaaaaccagccataacttaagagttcttctttcacccaatccccttggaattctgctttgctatagaaccatggtcaaaccaaggcaagcagcacaaattacatgaacaaagaatacaacaataaaaagcggatccttaagaccctcccaagaagaccaagagctctctctttaaaactctgtaaaatacctaggttctcaagtcttcctatgtcttatttcttaactaattgcactatcaattcaaaaatggaacaaaggatattctacgtatcagaaccttttttcctatacattaagaagaacttttcccacatgaataggtaatatcacagtctaaagccagaggatgaaacctatgaattcttcctatcatatattttaacaagaaacgtaaatatctatgacctacttatagccaatttatattttgcccaggttgttttgtttctaaacttacccctcatatggcttaataatgaaggccataaatgtgcctctttcctatctcacccctatgacttgacatgtattataaaatgaacttcctatataaaataatatttattgaatgaaaggaaagtattacatacaactttcattattatattattaagcttattttttgcacatcatggctagatcatcttaaaatagtttggctctgtctcttttcccatttttttttttattatactttaagttctagggtacgtgagcacaacgtgaaggttcgttacatatgtatacatgtgccatgttggtgtgctgcacccgttaacttgtcatttacattacgtatatctactaatgctatccctcccccctccccccactccatgacagaccccggtgtgtggtgttccccaccctgtgtccaagtgttctcattgttcaattcccacctatgattgagaacatgcagtgtttggttttctgtccttgcaatagtttgctcagaatgatggtttccagcttcatccatgtccctacaaaggacatgaactcatcattttttatggctgcatagtattccatggtgtatatgtgccacattttcttaatccagtctatcattgatggacatttgggttggttccaagtctttgctattgtgaatagtgctgcaataaacatacatgtgcatgtgtcttatagcagcatgatttataatcctttgggtatatacccagtaatgggatggctgggtcaaatagtatttctagttcaagatccttgaggaatcgccacactgtcttccacaatggttgaactagtttacagtcccaccaacagtgtaaaactgttcctatttctccacatcctctctagcacctgttgtttccttactttttaatgattgccattttaactggtgtgagatgatatctcattgtggttttgatttgcatttctctgatggccaagtgatgatgagcattttttcatgtgtctgttggctgcataaatgtcttcttttgagaagtgtctgttcatatcctttgcccactttttgatgtggttgtttgattttttcttgtaaatttgtttaagttatttgtagattctgtgtattagctctttctcagatgggtagattataaaaattttctcccattctgtaggttgcctgttcactccaatggtagtttcttctgctgtgcagaagctctttagtttaattagatctcatttgtcaattttggcttttgttgccattgcttttggtgttttagtcatgaagtccttgcctgtgcctatgtcctgaatggtattgcctaggttttcttgtagggtttttatggttttaggtctaacatttaagtttttaatccatcttgaattaatttttgtataaggtgtacggaagagatccagtttcagctttctacatgtggctagccagtatttccagcacaatttattaaatagggaatcctttccccatttcttattgttgtcaggtttgtcaaagatcagatggttgaagatgtgtagtattatttctgagggctctattctgttccattagtctatatctctgttttggtaccagtaccatgctgttttggttactgtagccttgtagtatagtttgaagtcaggcagcgtgatgcctccagctttgttcttttggcttaggattgtcttggcaatgcgggctcttttttggttccacataaactttaaagtagtttttttccaattctgtgaagaaagtcattggtagcttgatggggatggcactgaatctataaattaccttgggcagtgtggccattttcatgatattgattcttcctatctatgagcatggaatgttcttccatttgtttgtgtcctcttttatttcattgagcagtggtttgtaattctccttgaagaggtccttcacatcccttgtaagttggattcctaggtgttttattctctttgaagcaattgtgaattggagttcacttcggatttggctgtttgtctgttattggtgtataggaatgcttgtgatttttgcacattgattttgtatcctgagactttgctgaagttgcttatcagattaaggagattttgggctgagacgatggggttttctaaatatacaatcatgtcatctgcaaacagggagaatttgacttcctcttttcctaattgaataccctttatttctttctcctgcctgattgccctggccagaacttccaatactatgttgaataggagtggtgagaaagggcatccctgtcttgtgccaggtttcaaagggaatgcttctagcttttgcccattcagtatgatattggctgtgggtttgtcataaatagctcttattattttgagatacatcccatcaatgcctagtttattgagagtttttagcatgaagggttgttgaattttgtcaaacgccttttctgcatctattgagagaatcatgtggcttttgtctttggttctgtttatatgctggattacatttattgatttgcatatgttgaaccagccttgcatcccagggatgaagcccacttgatcatggtggataagctttttgatgtgctgctggcttcggtttgccagtattttattaaggatatttgcatcaatgttcatcagggatattggtctaaaattctctttttttgttgtgtctctgccaggctttggtatcaggataatgctggccttataaaatgagttagggaggattccctctttttctatcgattggaatagtttcagaaggaatgttaccagctcctttttgtatctctggtagaattcggctgtgaatccctctggtcctggactttttttggttggtaggctattaattattgcctcaatttcagagcctgttattggtctattgagggattcaacttcttcctggtttagtcttgggagggtgtatgtgtccaggaattcatccatttcttctagattttctagtttatttgcatagaggtgtttatagtattctctgatagtagtttgtatttctgtgggatcagtggtgatatcacctttatcattttttattgcgtctatttgattcttctccctttcttctttattagtcttgctagtggtccgtcaattttgttgatcttttcaaaataccagctcctggattcattgattttttgaagggtttttttgtgtctctatctccttcagttctgctctgatcttagttatttcttgccttctgttagcttttgaatgcgtttgctcttgcttctctagttcttttaattgtgctgttagggtgtcaattttagatctttcctgctttctcttgtgggaatttagtgctataaatttccctctacacactgctttaaatatgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgaattctagtttgattgcactgtggtctgagagacagactgttgtaatttctgttctttaacatttgctgaggagtgctttacttccaactatatggtcaattttggaataagtgcaatgtgatgttgagaagaatgtatattctgttgatttgtggtggagagttctgtagatgtctattaggtccacttggtgcagagctgagttcaattcctggataaccttgttaactttctgtctcgttgatctatccgatgttgacagtggggtgttacagtctctctttattattgtgtgggagtctaagtctctttgtaagtctctaagggcttgctttatgaatctgggtgctcctgtattgggtgcatatatatttaggatagttagctcttcttgttgaattgatccctttaccattacgtaatggccttctttgtctcttttgatctttgttggtttaaagtctgttttatcagagactaggattgcaaccccaccttttttttgttttccatgtgcttggtagatcttccttcctccctttattttgagcctgtgtgtgtctctgcacgtgagatgggtctcctgaatacagcacagtggtgggtcttgactctttatccaatttgccagttagcatcttttaattggagcatttagcccatttacatttaaggttaatattgttatgtgtgaatttgatcctgtcattatgatgttagctggttattttgctcattagttgatgcagtctcttcctagcatcgatggtctttacaatttggcatgtttttgcagtggttggtactggttgttcctttccatgtttagcacttccttcaggagctcttctaggcctggtggtgacaaaatctctcagcatttgcttgtctgtaaaggattttatttctccttcacttatgaaacttagtttggctggatatgaaattctgggttgaaaattctttaagaatgttgaatattggcccccactctcttctggtttgtagagtttctgccgagggatcagctgttagtctgatgggcttccctttgtgggtaacccgacctttctctctggctgcccttaacattttttccttcatttcaactttagtgaatctgaaaattatgtgtcttggagttgctcttctcgaggagtatctttgtggcattctactagagggtaattttcttttagggtgttataattattttaaaaattgattcattggaatatgttatcaatgtcaaaacatgagataacttgatgattatctctttatgaatttgaggtgctgagtatttcttgtttttcaattacagcattctttcaaatagccagtctcatgtttctatttctctcttagctgcttctttctttaatattttgttgctaatgagaacctctaccaaaatgagtaaccaaagggctgaagaaagttgaactgttaaatggtgtttgttaattgcttcttcaattacagaaggattttatatgttgagtaacatgccatttgaagatttgacaattccatcctctccttggtaactccccagtcatttggtctagattgatccatcatctttctcacttaagagcatttagttctcaccttcaaataatcagcagattaaaatagtggtacatagtcatctgtaggaagaaagaaataagctgtacagtagagtgctctgtgggtaaatatttgttgtgttgagatataacctgtgtatatttattaaatatcagtgacatttctttgcttattctttcattcactcaacagatattattgaacagctgctgtgtactaggcattgttcattttcccaaattctaaaattgtgatcatttctatttttaaaatgtattatttaacaaagtactggtaatgatatatatctttatttcccagtgggttttggcaatatagcataaagatcatgaaagtgggctctagaatctgagagcctgtgaaaacttcagctccaacactttctagttgtgtgagcgactttaggcaagttaatgaacttccctaagctcatttacttcatctttacaataggtataataatagtacttacctcatgtccactatctaaagagtaaatgggaaaatatgcaaagcatattgcactgggcttggcaggcaagtaatccctcaatagatgttaaatttgctgctgttattaaatcatagttcttgcttagttgattgttataatctttttcagtatttattgaacaaatacctatgaagtgtactcagagtaaacttggacagtgagagacaccaccatctggcctgttgtgtcataaacaaaagccttaaaactgggtcttggcaatggtgaggggaacagatgctctaactgccttctagaatgtgtttttcactatgtgtctaagctgcgatgaatgtcactaatgtcatctctctttctattttaggtaagtacatcaccatttttgaaactctgtgcagatgggtaagtcttgctgctggaacttttcctgttgatttgcatacttggaggatctggatcagacagtgtgcttatcgtggtcagaaaatgcctttattttattcaagcagagatctggaaaggtaacagaatttcccacacatgctttccatctctgtttcaaatctttggcagaaaaaaaaaatctgttatttttaattagataaaatgctatgttaaataattgaagatttaatttcttactctgtcaatagaaggcagagtagtttaaaagacttgagaaaagaaaaacaattgtttgcttcctattagaaatcacaaaatcctctctgaagtaaacatacaaatctttgtttttctgctttcaaacagggaaaattttttcagtgcctaacaaacaggtgtttcatgattagattattaatgagaaataattttgtatcaaatagaaaaagtgacaaatggccctgcaagaccatgtgtgcataatattgtagaaggaattcctgttatgactaagagttgatgtagttaatttagtatgtctaaagttggctgtaatctatcaccacagaagagctggaagaaatgatcttaaatcacaaaggatttagtaaagacctacgtgagctgtgaaagatgattaaactatgaaatagttctcaaaaggaagttataaattccttgccacttgtgaaatctaaaaactacatagacagttatgttcgtattagaaaataaagatttatcctgccttggcacaatgtattgaattggcatgttgttctcagtaacaaagtcccaatttgcttcatcagctttaattccctatttactccatacatactctatactctatgtgttagtctgagtcttgcaagaagcccatgccaaaatgggattagaaatgcaagaattttaggaaatgcccttgtagaggaatataaggagggagccagttaaggctgagggaaacgtcaaagcatgatccaagtttgactctgagtaaagaagggagagagaattggtgagagcatccttgattgggctagccaaaggcatatgggagtcctcaagccaaaatcagccatcagaggaatcctgtttcccaggaatgtgtctgccacaacatgccctctgtgctcagtaaataccaggaagcagggcatgggaggtatggccttagctaaaatgttgcagtgaatttcagaggcatcagttggggccctttgctggttatagttcctatagttggaggtctgcagcatatcctcacggccccacacagagactgttagatcttggttctttctgtttcttattttctattacaatgccttctatctccacatcttactcattcttcatgcccaaatcagttaccacttccttcatgaaggttactctgtacaacctagtggctaataattaccattctcttttgtaattcaaaaattcttgtatttttctgtgatatttattgttttttgttatccatttattcaaaaaaatggtatcgagagctgcatttgtgctagccacttttctatgctctgtgggggagaggatcagaaaaaaatgataaaacatgacagtctaatggaaaagataatactgtagaatacattaaaatatgacagaaatgtttgaagtatgagcaaaagatatgaggagacagaagaaggaagaataaccttttgggaaagaagggagggcagtgctcagggagggatggaggatttaaagcaggacttgacattgagttttgtcttggagggtgactagctcgttaggagttgacagttgaataggcatcattttcaagttcatggttatatgaaggagcatagaaaaggtttgtagtacagagagccttgcatgtcatagggaatttatgggattacggtcaaagagaaatctgcaaaattggcctaaagccagattatatggggcatcgggtcttggcaagtagtttggactttattctatgagcccaatccaattcagaacatctcagagtcatgtgggccaggctgaatgacaaaaatattgatgtatataattctgttatggcatactaaaatggtatgattctaccaaacaaaaaagatggtgatactatatatttaaatatgttgtctatatctaaaaactactaataaattacaatgaagaaatcacattttgataaaagaagataaaaatatagggcataaggccaaaatgtaatggaacgatttagcagactcttaatctcaggtgtgagatttgtcacgaatagctattttctgctcgatatatatttactttctgtacagtgtggttataaagacataactgaaaaatctagttgtcctcgaaatatgtaaggtatcaaaaagcaggattttatgctgagtgtgctttataatatttggaaaatagttataactagttgaagcattcaccagaatgtcacttgacaattctaactttaaatatctataagccataaagttaatatattatattgattttgatttttaatttgatgtaatttcagatttactgtaaagtggcaagaatagcacaaggaattcccagatacccctcaccaatatcccccaaatgttaacattttactacatttactttattcaatctctgtctctcatatctacctttctgtctatctaatcatctatgtatccgtctacccatacacacgtttccttattgatacacattaagagcaagttgcagacatgatactcctttgcttctaaatacttaaataattcctaaaaacatggaattatcatacataggtacagttcagtggttaaaattagcaaattaacatggataaaatgttgttatctaatctacagactttattctaaatttcaataattgtcccaataatgttctgtgtagccaatgaaattacaaaatcatgcttttcaatcagttgtcatgtctctttaatatcctttaaactggagcagtttctgagtcttcgtgaaagactatttcatgacatttatatttttggagaattacatgccaattgttttgtacactctcttgatttatttgggctgctataacaaactaccatagtcttcatggtttataaacaacagaaatttatttctcatggttctgaaggctgagaaatcccatgatctgtgctaagcagattttctgtctggtgaggatcagctttctagctcataaatagctgtctccttgctgtgtttttacatggcagaaaggaagagagagttctctggggtctcttttataagggcattaatcccattcatgagggctctgtccccataatctcatcacttccaaaaggccacacctgtaaataccatcatattgctgattaagtttcaacatatgaatttggaggcaacgtaaacattcagtctaaagcatagactatctttcaatttgagtttattttgtgtttcctggggatgatagtcaggtcatacaacttgggcaggaatatcacagtagggatgctaactccttatatccagaggtagatgctgttgtttagtaccattactgacaaatttagctttgatcatttagttcaagtggtgcctaccagatttctccactgtaaagttactattttcctcctttgtaattaaaaagcattttgtaccatgataatatgagagcatgtaaatatgctgttattcctcaatttcttacccaatagctttggaatccgttggtgattcctgtctaaatcagttacttgtgttattatgatggttgctgttttcattggtttaatgctgctgtaacagataccacaaactgggtaatttataatgaatagaatttatttggctcatggttctggaggctgagaagttcaggatcaaggggctgcatctggtgcagtcctttttcctgctgcatcatgacatgatgaaaggtatcacatgggcaagaaatagggagaagggggccaaactcattttttttttttttttttttgagacagagtctcgctctgtcacccaggctggagtgcagtgactccgcctcggctcactgcaacctccacctcccgggttcgccattctcctgcctcagtttcccgagtagctgggactacaggcacccaccaccacgcccggctaattttttgtattttgtttagtagagacggggtttcaccgtgttagccaggacggtctccatctgctgacctcgtgagccacccaccttagcctcccaaagtgctgggattacaggccttagccaccgcacctggcccaaactcattcttttataaggaacctactcctatgataacagataaagtaatccattcatgaagggaatgctctcatgatctaatcatctcttaaatgtcccaactcttaacactgttgcgttttggtctaagcttccaagatgtgaactttgggagacatattcaaaccatagtggtttgctaaggggaaatcttgtaatttcatcatttcttcctcttttattagttggctttctattatgcataaaaatgtttcttcgtgcttgtttctgtgtggagtcatgaattctttatttagcaggttgttatcctttaatattgttggttaatatcattatttatcttaatcctcatactgtcctggatttggacagtacaaggtacttctagttgactcccttgtcattttaacacgttactatcattctttgagtacttttttactttttggttttagatatgagactcttgttcttttatccaagccttggaatcagctacttttatagggctctctgtttcctttcagtaaagaatggtttttagaaatcaaaatttggagagtaggtgtgcttttgcttctaggtccttttagtagacatatctagggggaaagtgtatgtatgtacatactcatatataaatgtgtgcatatatatgcatacccacacatacctatatccatgggtatattcagatatttgtatacattaaacctaggatttcacaatgataatccatcattgcagtgctcattctgttcttctccattttcgtatctgtaactctgtgagaagttacggtgagaagcctggctcccattattcacaatatattatatattgcataggattttcttacctgtggaatgtggtttcaaaaattactttcagaattacccactcacgcctctatggaaaaagagaagtaaggcaaagaaaagtatttcagtaagtagacttttagcattatttatgttttatatgcctaattctgtactcaaaattcacttggttagttcttttctcacagccacttccactcacttcacggttctgttacttattttaaatatggatcagttaatttgttttaatatataaatttgttttcatctagagttgaatcgattaatctggaatgatattttctgtttctatgtttaaaatatcaactaataatttcctttccttaataataagaaatctctagcaccatttaagactcagttaactgaggtgtaggtatccatgttttcctagagtatagagctgtgatctaaatcagaaaatctgaacaagtttgtcttggaccaaacttcaggataatctggaaacaacgggacaaatgttagtgcatgagtattttcaaacatagttctgagtaaattccaaatgcatatgtgggtttgtggctcttcatatctggttatttgtacatgatcacatctttattgtagataataaaagttgggtataaaagcaatgccattaattatgtattttttatgctttttgtttcaaaaaaggaattaagcaatcctaactttaaaaatggataaaatgcctatgtaaagctaagttagaaacacaaatgtaaaagtgtatttcgtacttggagttaagtttaggtcttaaaatattaatagcttcctcaaagatacagcaaatagagaaacctgataatatttatgtcttgagagaaaattatctttctataattaattataagacttttcattagggtctttgtgtaaagtaaagcaataatatgtttaatagtatttttatgtgagttacatacatgtacattattaatcatgaataaatagtgatgttcttatacttagtcttgttataagtcaaaatattaaatcattattccatgaaagtcttcatatagtaatttaaatcattgttaagtctggttacttgatgttgagaaagagcttagtacacatagtagaatgacttgccagccttgccattaggttatctttctcatacattacttaccttaagttggcaggagcttgattacagaagataactgtcatttatctctttgtgtggagtgcatatattgtgggatgtctataggagtattacccaaagggtttgtattacagaattatagttaacaaaatcactaggaaatgtttatggagggaagataaccacagatatatctgattacctatttggaggactagcagtggaatttcttgctgtttctcatgtggccaaaactaataaaataaaataaatttagaagagttttgttgtaccaagataatccatatatttcagttggtatggaaaaacatcttttctttcagccattgttactatgacacttagacactctagtctacaaaattatcctaggtttagcaatattggaattaaattttattgttccttcctgattgcagagttataaaaataaggattgagttattatgagaggccgattgtgtaatacatatcatgagttaaaagtaaacgttgacttttattataattgccttttgccacatgagagaaaataaactaagtgaataagactgtctctaagtcttctctgagattaatttgacaatttactagaaatagaaagattggtaatgctcagtctaggaaaggggtaaagaaacaggcacacatatattacttgagagattgtaaattttgtacagttacaatggtaacactccatgtcaaaatatgcatataacaatgcctcttgtagacatttatcctcaagtaacaagaagtaggcaaagattattttatgtattttgaccgtcaatgagttgataatagtaaaggactagggagggttggtgtttaaaacaggccaggtgcggtggctcacacctgtaatcccagcactttgggaggccaaggcggatcacttgaggtcagaaatttaagaccagcctgaccaacatggtgaaactccatctctactaaaaatacagaaatatccaggcactgtggcaggtgcctataatcccagctactcaggcgcctgaggcaggagaagtgcttgaaccccagaggtagaggttgcagtgagccgaaatggtgccactgcactccagcctgggtgacagagccagactacatctcaaaaacaaacaaaaaactaaaacagactaaattgtggtacttccatattttttttaatgatagagatattagcattgaaatttgtcacaaaactacacataatgtaattctttacacatttttaagtatatgggctaaagtatgaaaccaactctgagtaataggattataaatattctttatctccttgtatttatatttatttataccttaattaaattttgaaataatgttgttacttttacaataagaagttgtgaaaaactattaccatgaaaataatctagcaagaatttgatttaacattgctcatttcttgaaagcaagccaagacatttttttttactctttttgagactgagtttaaggtatttgatcaattgttagaggatgagtttatcattttagtgccttgctgatttgtgcaggcacctcagttttaagtaatcatgggattatttatttgttgatttagcatttgttcagtacttatgtgcttaatagcacttgaacatacaaagagaaatgagatttttggtccccaagaattaaaaatttaatggaggagataatcataaacttacagagaagtatatgataggctgtgtcaaagtgggaacaatgtagactagggaaatacaatgcttctcttggatgggtcacacctaggaggggccaaaggggacaactcactgggtattggaatgatctggatccctggattacttggttggtgctgggctgattcggaaaccctttctattttcaactcttctgctaaacatcattatagtaacatcagtacacatcctgctgttaccaagtgtcagtgtttggtcagtttgagttttacaggcatatagaactgccattttgtcatttctgtctacattgtacaaaaaagtaatttaactgagctttataacttatgatttggagaactccacagctcccgttgttctttctcaaaaaattattttcagtgcaacttagctttctgtgtatctccattgctcatctgccctagatggttcaggttggttgctgtctctattagtgtgacaagagttaataaaatgattaattaaaaagagccttaaacgtctacttagaaaacactagataaatgctaagtagggtgctttttggtggatcaagagagtccagatcactaatatatggatggcgtataaattaaatcactgtgtaagactgcaaaatgtcagagaaacattttaatatgttccccccagcatttgcctttctgtacatatgtcttagaattataatgcctacattttaactatggttttctgtgggtatatatacaaatagatagcaactgattaaaaaaaaagatctcaacttttttttttcaattcacaagattggagtatttggagatagggctgttttttctctttttttccttttaaagccatccacattttcttttctactgctttctcactcaaaaaatgtaagctagaaaaagttgatctcatggaagtaaaaaggagaacagagattactagaggctggaaacagtagggagaaggggaggatagagaaatatttgttaagaatacgaaatgacagctagataggaggaattaagtggtagtgttctatagcactatagtatgactatagttaacaacgatatattatatattttcaaatacttagaggatattgaatagtcccaaagaaatgaaaaatgttggaacatatgctaataccctgatctgatcactatgcattgtatgtattgaaacatccctacgtacaattattatgtatcaatttaaaaaatatctaaaaatatatgtgtacctaagtgtatacaccttatatatcctttgatttccttatgaaacacagcatagtttgagatttaaaatgaataaaatggttctttatgctctgtaaaattagaaaatccttcagcttttagaagctctctgttggtttattagttgatcacaaattaatatgtccctttggtttaatctgtatcataaaacaaaagttgactgttcccaaacatgtgcttggataagagaaagctgttaataaatatctattgactgaatgaaagtataaatgaataaatatttttagcccttagaaatatgtgaaaaatacctagaaaatattagacataccaaggtcaatgctaaatgtaaaatgtatttctaagaaaactctaagtatgcaaccatatggattgattaaaactagttacttaaaacctcttatgactgtatttttcttgtttttgaaaaataaatgcagtttgcactctccttgcttagaacttacgtattctatttcacaaaagtgcatgcttgtgttattaaatgtgtgtgtgtgtgtgtgtgtatatacatatacatatatcttgatccctaatctcagttagctccaaaggtgttctaaatatataaatgttataggtcacagtgtgatctcttaacactatattttttggttgagtgtggtggctcatgcctgtaatcccagcactttgggcggctgaggtggaaggataattggagcccaggattttgagatcagccagggcaacatagtgagaccctgtctctactgaaaatacaaaaaaattatccaggtgttgtggcacgtgcctgtagtccctgctacttgggaggctgaggtgggaggatctcttgagcctgggaggtcgagactacagtaagccaggattgcgccactgcactccagcctgggtgacagagtgagagaccctttttcaaaaaagcctacgtttttcaccaacacatttcaaaattacttttaaaattattattgtttttaaagataggtatgtgccaaaattagaactttgggtccaagagcatctccacattcacataaagaaacttaagttcagtaacttgctcaggctataaagtagaagagttaggatttgaacccaggtcagagggctccaaagccctttcactttccatcaaaaacatttgatattttgccaaaaatatcatgactgtttgtccattgccatttcatatccttcaaacagctataaagtgtggagaaatgataacttcataactcacgctacagctcgcagacacacttaattagcttagggacaaacagttgtgacattatgagtgggagttgcaaggctgagttgaatgtactgatggggatgttggttaaaaacaaaaagccattctattctacatcgtggcaatctttgtacttcaaaagtagtagtattctgagacgtttactgtgtattatagatttgaatcacaattcagcaatactagagaaggagaaatctactttttctaaattttctctacagtgaaataaaatgcttttggaatatttacttgaggaatgggttatctgaatgttctcactgaaactcattacaccgtatagtgaaaatctagttacaggtagttgaagtgtaggtatagatagtatgtgattcataatgacgcatgtatgccatgatttacctcagtcactggacagtaagaatgtgattaaggaagtttcctctgcaacatttcaagataagttagctgttttgagccacacaaatattaaactatgcattgtggccaagtgcctataatgccaaaagcacctgtttcaaattgtgagtaatatcttatgtgttacactattgaaatctccttgttacagaatattaatactacctattgaaaagagtaagaaataagagtttctcatttccacccttttggatttatttcatcaaatgatgtgttgatgaataatgccctttctgtaagatggataactcatggaaagaaagccatttggacatggatactcaagattttaaagaatttaggaggtggcagtgtgaatatcaaataaggtgccacttgtagagagagtatctcagaaaaggagcagagaatcatacaatagaaaagtgaaaagctgtttcctgtggtagatagactctaaataatgattttagagacagacataataaattaatttattggttcattgaagaaacatcctgagttcctatgacatgctaggcattgtgctggtgggggcgagggttgggtgagtagtggcgtatggagatgaaaagatgcatcagacatggtccttgtcttcatagaactttccacagggtaaaactggaaaaaccctgctgggacagagtgggcatctattccggcttaggcaagcatatcttatcctattgatatctgtacaatattatccttaaactagaaatacaataatatgttttattctgacaatgaggaataattttccatattaaggaataggttaatctctaaatagtatgctatttattttatcttactttttcctctgtgtttttaaatatttaacaatttaggtagcatcctagcagggcatcactagagaaataaaatgaagcatttttaagtaaatatattttacagatcatttggaattgtttcaaaaacttcattaacttttaatgaaccaaaaatatagttcattggaattaaatgttccatgtgaagatatttatttcggaaactacatgactaaaccaatggtaagttgaagttaaaaaagtgaccccaagagagggacaatgtcatattattattgttataacccatatatgtttaataatgaccatgcaggatggtgcatatagcaaataactaggtaaagtttctaggaatttttattctatttctcttctttcaattctaatgtatgggccaactcatcattttaatacagagctttgagagaaaatgcataaatgtaattttctgtatgatcactagatggcgccatgcttcccttagaatgaagctgctcaggaatttgcaagtgcagttctgagtatttcacatagaaacctggaagatgagacaattgtatttcccataaggttttgattcactaatatcatcaaaacaacaattagcacgtgttactttgcattcaaaaagggagtaacgattgggtttgtaaacagtatattgaaataatcattactgaggacaaaagtgaagcatgcctctaagaggtaattcggaaggtctcttttgctttccaaaaacatactagtaacaaggaaacatcttatacttgcttggaaaactgggtcctagtcaatgagctatgtcttaaggaatggaaatactggcaaatgtggtaaagtttacatagccattttctgcaaaccaagaagataaattgcattctgcctagtcttaggcaaacagttgggccatttactgttccatcaaaaaaaggattgtcagatccccaaaagcacaaggatgcatatagagtgtccatttaaacttcctgatcaaagatatacactcgtgaaggtggagtggaagacttctttataggagtatgattcatgtttataaaattggagacacttagaaagttgagttaaaagtgactcaaaggatatcttttcattgccctttttatagatggaaaaacatggatgtagctgtttcatacagctaagacactagtgcatcaaaacacaatacatttgtgagacatcttgttatgatttcaaagcagtttgtcaataaatgtgtatgttcaatggttacagtttgggatggtaagacatcatcagctcagaatagtaacatccttccctttatcttttttatagaactttaaacctggatgcaattttaagatcatatgcatcattttttctatatggtgattacattctagataaattaatttgtgatacactctggactttttgtattacatcaagttgaagtttccttttgtggacttagaaacaaaaaatttgcagtaataaaaatgaaaagagattatgcaaaaataattactaatgaccatgtttcttaggtgatgaatttaattgagtgttggtattttaagaatacgtgcatcaagcaaattataatgtaaccaaatatccagagatttgaggaggaatatcaggttattatcacatttcagagctgaatttttcttctttggttcattgactgcattgaatctttgttttgtgggtgatataaactttttcatttcattccttgctctaggagtgactctggggaatcattaggtacatgcttgttggttttccataataattatctctgagccctaatggtttctggatttggcctctcttcactttctccaactttaggcaggagttcagaatggccttcagttgcaaagagaagtataaatccaacttaccatctagtctctttctgtgtggtcttggcaaattttttaatcctggctaggcatgctgttactggcagaaatgaggttctgcctcaactttagctccagccctgccgttagcctgaagactttccaagatttagggagggtccatgaatatctcatcttcaagagtgtgctatagagttatcgagcaactcagatcttttaaaaatcttgagtttaggaatcatacatttaaatgtcagttctcctagaaaatgaagattttaatcctttagaaaaaaatctagggacaaggaattctagcatttcctaaagattccatcataagtagtgcttttaatgtaaagggtttctttgaaaaaaattatttctttactttttttttttttttccttgagacagggtctccctttgtcacccaggctggagtggagtggtatgatcatggctcctgcagcctctacttgctgggctccagtgatcctcccacctcagcctctcaaatagctgggactacgggctcacaccaccacacctgtctcatttttgtattttttgtagagaaggggtttggacatgttacccaggctggtcttgaattcttgggctcaagtagtccttctgcctccatctcccgaagtgttgggattacaggtgtgagtcgtcatgcctggctgtaaaattgtattatatttctaatatgaagaaatacttggtttctctttactgtttagaaagataattatcatgattgttttctttattaactcctatatgatactttgtatttttatcccctgctactcaccccaagcttatttttataattagaaaggaatcaagctagccaaacaggagttatccttccttaaggtagagaagttactattttttttcaaatggcgatctgcctgcctgagttgctatttggatctctgatgatttcttcctttgatcccctaactcaaagcaggcaatcaaggctatgctgttagttgtaaccagatggaaacctgatctccatttatactttgcctcttgtattgataacaggacatgaaccaggatagatacactaacagtatttgactctgctgcagttgccaggctaaataaccagaactcatatctcattctactctacctatggaaacactctgtataatgaaaatgtgtgttgaaagtgtgtgggtatatgttgtgtgtatatgcattaaaattctcattagcatgggctggttgtaatagtgcatacctgttatcccaactacttgggatgctgaggcaggaggatcatttgaacccagagttcaaggccagcctgggtaacacagcaagaccgccatctatttaaaaaaaaaaagtaaaaactctcatgagaataataattaaagtagctatgttgatcattgcagtaattaaaccaaaatattaatactcatacctgatatagttttttccactttattataattacatttctctcaaaaaatttaagaattagtatatgtttaacatatacaggttgaatatctcttattgtaaatgcctgggaccagaagtgtttcaacctttgaattttttttttggattttggaatacatgcatacacatagtgagatatcttggggataagaccttcatctaaacacaaaatttatttatgtttcgtatataccttataaacataggctgaaaataattgtatacaatattttaaaatgctttcgtacgtgaaacaaagttttggctgtgttttgactatgacttgtcacatgaggtcaggtgtggaattttccacctgtgacatcatgtcagcactcaaaaagttttggattgtggaacattttgcattttggattttcagattaatgatgcttaacctaccttgtgaaataatggagtcctttattaataacaaaacaataatagatgatacttacagagtacttgtgtgtcaggctctactctaaacattttatatgtattaaaccaattaatcttcacaaaaactctgaattagatatattattattatttccatattttagaggagaaaactgagaaacaagtaatctagtctgtactctaccataatgctatgttacattctatcaacactcccactgcctcttctgaattcattgatagtggtgtggtggcatagagtccacagagtggagcattaattaattttgcataatgtgaaagtaaaacttaagaaaattttaaggaatagacagtgtgcagtgttatggaatcataactatacaattaaggggttaaatgaaatcatgcccaaaatgctgtgttttaaatggtggcactgactgataaaatgtagatttgagttatttattgtttctacattctcaagtgaaaaaggaagaaagtaggaataaaattctggactattggggggggtgtctttagtcttgcaaaaagtaaaaaatagaaatagaagaaagtttttatggttcatattgtaacatcaaaatatggaatgaaaactgtggtctcccatgaagtatttcaggtgctggaaggaaatctcctagactaggactctcagcaagtccatggttcctattatgtccagcatgccatagaaaaactccagaattagttaaattttaataatttaatggagaaaactaatttttcaaggggcagctagttaacttcagcatgagtcaaaaagcacttcatctgtcaatatttatgtaaatatttattttgaattatacatttatttagagtatttatttacattagaatagagggaactaaggccgggcacggtgactcatgcctgtaatcccagcattttgggaggccgaggcggacagataacctgaggtcgggagtttgagaccagcatgaccaacatggagaaccatgtatctaccaaaaatacaaaattagccgggtgtggtggcagatgcctgtaatcccagctacttttgggaggctgaggcaggagaattgcttgaacctgggaggtggaggttgtggtgagcagaggttgcagtgagccaagatcgtgccattgcactccagcctgagcaacaagagcgaaactccatctcaaaaataaagaataaagggaactagccatctgatcatattacaaccaaagccttttattttcttcataacctaactgaatgtgtcaaacagtttgtgattctgtcctccaaatatgcatgtatattccaaaagaatctgtgaccctcagtaggcctgtttttaagtcagtgaactaattctttctttctttcttcttcttcttcttcttcttcttcttcttcttcttcttcttcttcttcttcttcttcttcttcttcttcttcttcctcttcctcttcctcttcttcttcttcttcttcttcttctttcttcttcttctttcttcttcttcttctttcttcttcttctttcttctttcttcttcttcttcttctttcttcttcttcttcttttttttcttgaggcagggtctcactctggactctgtccaggctggagtgcagtggtgcaatcatggctcactgcagccccaaactcctggaccgaagtgatcctcctgcctcagcctctgagtagctgggactacaggcatgggccaccatgtctagctattgttttaaattttgtagagaaaagatctcactatgttgctcaggctggtcttgaacttttgaactcaaccaatcctccagccttggcctcccaaagttctggagttacaggcatgagccaccatacctgctaactaattctgaaagataagtcatagtattgaccataatagtgatgaaaataagtggaatcccaggaggaagcctcatctgcatgtggtgaatatgtaacagtaaagaggatgatcatagtaaggctttctactgtgcatagcatgttagcttttactcttgcttttacatattcatctcatttaaagtttttgctcattttaattattctatgatagatatgacagaggcagggaaagtattatcctcttctccctttactcccaattacagaggagtacctgaatcccacagaattgacatatttcctcaatatcagttagtcaacatcaaagagacttgaactgctatagtcattatatgcagtcttaaggacacactctccacattttaaggtttaaggatggataggatttccacagaagtataaacagaaaaattgaagacagaggaaagaatactggacaagggcaaaaaaacaggaagtatggtacaacttggagaaaatgccagtgagctgctaagctcaggtacaggatgaagagaattagcaggcagatgttgatggaatgccgcaggaagatccatcttgaatggtttcgtgggaacatagactggatgtgtgatctaagaaatataagactagtgggttagactcagcaaggggtaatgtggagctaagtttgatgactatagatatggaaagactcagggacagatgctacagaaatttcaaagttttgataccatattacacaaactaatatggcgcttgaaaaagagtgagacatctaagatgattctcaggttcgggtctgaatgactgggagaataatgatccaggaacagaaatagggaaatcatgagaagatgctaaattgggaggagatgctgggtgtgatttgctgagtttgagtacaagcagaccatgcaagtagttatgtctaacttggaagcaaagtaatggtgtgcacctgtagtcccagatattctggaggctgaggtgggaggatcaattgagcccaggaggtcaaggctgcagtgagccatgatcccaccactgcattctagcctgagcgacagagtgagactctgtctcaaaaaatgtaatgcaatgcaatgcaatgcaacgcaacacagcaaaacacaacacaacacaataaaaataatgccttcagaacctcccccccaaaaaaaaattctaggagggaagtggggtaagcctagtgaaaattctcaggctaactgacaatgtgtatgttttgctaaatggacttcagttggcaaatcaaatttttgagttagacattaataatattgaaatgtaatatccacccacattgtccatttcatagaattactctgtttttgttgttcattttgacatttcctaagctgtcacttgacccagactgacacattatcatctgcatgcacctaggctctgccttatatatgtttacaacatgcaatgaagcctagtgcctgtaatcagaaagagggtgctgcagtccatcatgtgaaaaaagagctggactatgaatgaggaaacagattttactctgacatcaaggctggccgacagcatctgtcatgcccctaacacaatcatgctaattataagccatcactttcattcttcttggaattcagaagtcaggagggttgtaggggcaaatttctaacgggttgtggaatctatcattgctaggaccttttacaattcagttgcttactctttttaaaatctgccattcagcagtctttttcagtaccagtaagccacgctatgcattcctatgaataaagtgcacagcaacagcatccaaatgcagtgacggaactgtatggcttctccttggaatagcttttaaaaacctgcttaggcagggacactttattgcttgctgaaaaattccaaaagatttgtgactatgtttaataaattatcaagaactatatagaattccttagaccttttttctaaaataaacttttggagattttttgtttgttggttgttactattatttttagagaaaggacaattaaattatcttcagatcccagggaatggtagaattagtctttttggcactgatagtaaggtaggtcatgtcttagtccatttggactgttacaataaaatatcataaactctgtagcatggctgggcacagtggttcacggctgtaatctcagcactttggaaggccgaggccggtggatcacctgaggtcaggagttcgagaccagcctgggcaacatggcgaaaccccatctctactaaaaatacaataattagccgggcatggtggcgcatgcctgtagtcccagctactcgggagtctgaggcaggagaatcgcttgaacccaggaggcagagcttgcagtgagcagagattgtcccactgcactccagcctggccgacagagggagactctgtctcaaaaacaaacaaaaaactgggtagcttataaacaatagaaatttatttctcatagtgctggaggctggggagtccaaagtcagcatgctacagatttggtgtctggtgagggccaggtttctggttcattaatggtgtcttcttgctgtgtcctcacttggaagaaggggcaagggagctataacttggaagaaggggcctctttaatatgtgcattaatcctgttcacaaggctggaggcctaatgacctaattacctcccaaaggccctacctcctaacactattgcattggtgattagatttcaacatttgaattttgggagggtgccaatgttcagatcatagctggtcatttcagcttatttgtactctctaagttatgctgcaataattgttggcttctgtacatgggcaatatggaaattaaagcaatcataacattttggtagaggacctgaggagagattattctgaatgtgatgaagttatagtctttttcctcaggtggattagatcactttttggatagaaattttatgttgggaaaaataaaaatggttcagtgacctgaggcagaaaaagtctgttcacaggaatataagataattactccatcaactcacagttgtttggaatgtcaggatcaataatagtcctcagaacattgtaaccttactccagcaactatgctaacataaagcagagaagtctgaagtctgtccattagtattggtgacaaggtcatggttgcttttaaactttgcttgccaaaatacctggagggaactcaatgtgcatactcaagtttctgctgtggcaaattgactgttgctaccccaggagaccctaggaagacaatcagttcatgtctgactggagacattgcaactttatttgtatgaactatttgggtcaaatttcagggggacatgtcactacagaggggcagagggtcatgataatgaaaagaatcattacgttatattggtaattagatgtatgactctacaaacttgtttttccttgggtgttagtaacattctttttggagatagatggcattttacaaagtctatccacagaaaactggaagtatctaaagataatgataatgacgagaatatattcattgtaatctggcatacagaattttctctgccatttaagaagctgaatttcttttaagtatagaaaggttagacttatcaaccttatttgcagatactatttatgtttttcatgttttctctctgtccttaaatattttctgagatttaggcactgagctctctgctagacattttcaaattttatcttttaaaaaatcagaaaacctctctttatgaatgaaatttttcacaaaactctgatatataaaacaggcaaaatgaaaccattatggcaggaatgagtctgggatttgcctatttatttttctttcttctttctcctgtctgctaaattttctacaagcaaggcaagcagttcatgaatcaactgttgactacttctgaaacctaaaatgaaataatatatatgaaagctgttattcagtgatttatacttatcaaaatatacttgtcaaaatattaactgatttgtgtttgtcaaaataaatatattcatacatagcaccttggtaaatcacagatctagttgtattgtaggtgcctagaccaacatgacaacttgattatatggcttgagatatttacatcactcttaccacaaaaacgtcaataaacagagcttattaatcttttgaggaggaggaaatgaaggtgtaggaaagcatgtatgaagttctacagcatttgtatacatccatctttgggaactgagtgagcaaaaaagaataaaatgttgatattagcatgaaaactctcactaactctataaatttcttgtcaatattaggcctgtttctaaagccaatcagaatgaaggaagagctttttaaaaataggcaaatgttggttacattggcttcaattttaaaacaaagttctacattctcttcagaatgcgaaggaggttgaaaaaggaggcatttcctgcatatattttgagatgagacgagggtgagaaaaggagtagagctgaatgttatgttattctgttaacctttgtcaggcccatcaggctttatatggttcaaatttctgctgtatattttgatactttctgtctccacagcagttactcaggaatatatcccaataatgacactgaaaatgcagtgaatttataaatagatcccgctgctgcatagattccattatttagaaaattatacagcgttctgtaggaggttgaacatacagtaaaatagttcatttgcttagaaacaattattataattgttattataaaatctaatagattattagaaatatcacaatataatcaagcaagcatcagactaaataaaatgattatttaatatttgcttcatatgataaagaaaaacttaaaattgattttctatttgaaaaatatcaacagaggctgggcacgatggctcatgcctgttatcccagaactttgggaggctgaggcaagcggatcacctgaagtcaggagtttgagaccagcctggccaacacagtgacaccccatctctactgaaaaaaaaaatacaaaaattagccaggtgtggtggcaggcacctgtaatcccagctactctggaggctgaggcaggagagttgcatgaacccaggaggcagaggtcgcagtgaggcaagatcacgccaatgtactccagccttggagacagagtgagactccatctcaaaggaaaaaaaaaacaaagaaaaatatcagcagaaataagtgagttgagtaatttctaaatcttatttcctatgtaagtggttaagaaataattaacttttgttctagaagtattaaggagacaaattgcaaaatttaatgtgaagccttggctcacaataaatactttctttaaacttaggatatatttaaagtggaataatattttccaacttaaaatgtaaccatttatttttttctttaatgtgtttgtgtatacatctccttctttgtcaaaggtttgagtagaattagaaatagctgcaatttacaaaactctattttgaaaggaagaaaattaataataaatagcagaagtaaaagttatctttctggaatctaggactctcacccactctcatcttcaatatttaccccattgtttcacatatggaatattataaaattaaaatataagagaacggatatgttattattcaaattattttcattgagggtggtttgcccagtttcttagaagcaattaaaaggagaggataaggtggttttcttaaaatagtgctttctttctgctgaatttatgtaacttttttaagaatggcaatctaagtgtacaaatgatgtttaattctcatgagatttcattttaaaccttgctttagagtaaactttatgagtaataagattatacgtgtgggaaactgaaactaaaaggattcaaatggttttgacaaacaacagatattcagggtcagtgcaaataaggttacagataatcactccatctgctccattgtcagcaaaaatgaggcccaggtgttgcagtataccttgtcctttctcctgaattgtgaccattgacaaataagattttcaaagagaagtctgaattccttagggtttagcctgagctcttgtaagagtttctttccagccaaagtattttcttgttttcctgtcaattcaatgggttagaccattccatccattagaagaaagtagaggaaatggctcaaccttgcccagagtacagctggttggaactctgacaacggaactgtggcccagggtaaagagcaagaggctgggggaagcacgtaatgcttcttaaagcctttgatctaaaatgacagactgtcatctccactcacattccattagcccaagcaagtttgtggctaaccagacaatgggtctcagcaatatatcccccctcccagaacgcctgaacattcaagtggcaaaagagtgaattgttgagaacaataatatagtctataatagcatataatgttcataaaattagcaccccaggcaaacaggacagaatgcctatccccagccacagctttatcctggcctacaatgctcatttatactttctttcctgtgtgaaatgaactacacttagtttattttaacctgatttttacaaacccataaagaatgcaagagatgcagtgggccaggaagaagtgagaatgttgccctatgtgtgattttttctagaatctgtctaagttctgctttattcctggatatcttgatatggaaaattaataggattgcatggtaacttccttatacacaagtttatttacctaatttagctcaggagtatgactcaattactagcaacctaaacatgcaataatgaagggaatctccatgttgcttatgcaaacatctagagtcatatgtcactttgtaagtagacaaaatgtagggcatgtgggctggacatgtcaacatgctgctgactttatctgtcattaatttttgttgtgtaaattagcatcctaatgacacacccccactgtattcattctgtgccctgtctcgccccttaacttggagcaggtaatggagtttttaaacatcatttgataatttgccctcttcagaaagtaatactaaggaaaagctatttaaagtgagcagaattccttttatctgttgatttagaaatattatttatattgccagaaatttaaaatgttcaacatgtttatagttattaaaactttgtaaaagtaaagtatgttaaatcttcaggagtatcactggaggagctagatgacaaaatatatatatatatatatatataatattatcatgaaaatgcagtgctggcaaactgctcctgggattataaatatatcagtaaaaccaccctttctcctgtatcctttcagcattagccataaaatagactggccagtaggggttactcttggcattatgatctaagagtggtagattagagtttgaagacataatgagtggtatttttaaaaatagctattatcgttgtgaatttaggtgcaatattcagaattcagaattggtgataacttgctttgagcactgtttcagcagcttttatcctattcatatgactgtcagacatattccaggaactattttacttagccttgttgattgtccctcattaaataaaatccacaggtcaaaattgtaaagtagccttttagttcaatttggcatctttttttcctgggtgatattctcagtcccaggggtttgaattccagacatccttgaaaacaaagccttatatgaatgtagtcagaactaactctttaaaaggcaaaagcacaaccacattcagttaccctaaagtaactgtagtcaggtggctcttcaattttagaaaataaattactttcaaaaagaagaaattagaaaagggaggaaaaaaataatgaagcctcatggacatttgtttttgagagagaaaaaataaataaaaggaagtggttttaaatattggtttcataaaaacaaaacttagaaaagctttttgtctgaagcccaaatggttacaaatgagctctgcttactaaacatggggcagaaagagttcattagaataaaatactattaccttcagaagaaatatgtattaccaagggatgaaatgcaaaagttactaattcaatatttatttatttatttatttatttattttggcgacagagtgagactctgttgcccaggctggagtgcagtgctattatcttgactcaatgcagccagcctctgccttctgggttcaagtgattcttgtaccttagcctcgtgagtagctgagtctacaggtgtatgccaccacacttgactaatttttgcattttcagtagagatggggcctcgccatgttgcccaggtgagtctcaaactcctgagttcaagcaatccacccatctcggcctccccaagtggtaagattgcaggcatgagctaccatgcccggcctacttcaatatttattttttaataaatcaagtttgttatgagagagttgtcagagaataggaatcttctaactgctggtatcttgatgcattcagagctcaaggatgtgtggtgtggttcagaccatttcgtgcacactgtagcagaaggattgccctttgatggctgggcaagggaacattatgatagatgagttatcaaaatattgctaaaattctttaggcagtttgatatagatgttactgtagctggacactgtcagagaaaggagatagctgtaacagagtaccaaatgaaaaacatttttgaatagactgtccttaagacttcttacctacgaagactcctaatctcttcttatgacataattatcggaaaggcctggaggccacaccttgagaagaaaagcacttatcagttgtgattttcattttcttcacagttttctccactcagctagcttacagaggaaaccaaaatgcagttggttgtttctctttactaacactcagttcctaagtgcttagctttagaagttttttctgcctgtttacttccacttcttgtgtgacataacaatattttagggttttatttttcttttcaaaattcttctggtctttggaaagaaaattaagacactatttactctatgtttgctgatgcagaaccagtaagtttgttcacccacccaagtgattcattctaagcaaattctcccattaggcatttgttgcaaatctgcaaaagttgcttttatttactgattcaacatatcccttcccagtataaggatctcctttgacggtgaaaatctccttggattgcataggttttcattgtacagagaaggcttgaccttaaaaatttaagttgcattaaaatttcttttatgttttagagagacagaggcactctgttgcccagactggagtgcagtggtgcagtcatagctcaccgtaccctcaaacccctgggatcaagtgattctcccacctcagcctcctaaagcattggcattacagatgtgagccacctgcttggctgaaacttttcttgaaacacacacacacacacacgaacactcacacacacttttttatttataaagatctcaaccaactttttaaaccatgcaataaaggaatatctttggcattggcaatgtatatttgttgactgctggagtcctttgggcaacatcaaacacccaattgctcattttaaaatctggctttccacgcctgtaattccagcactttgggaggccgaggcaggcggatcaccaggtcaggagatcgagaccatcctggctgacacggtgaaaccccatctctactaaaaatacaaaaaattagctgggcgcagtggcgggcgcctgcagtcccagctactccagaggctgaggcaggagaatggcgtgaacccagaaggcagagcttgcagtgagccgacatcgtgccactgcactccagctggggtgacagagcgagactccgtctcaaaaaaaaaaaaaatctggctctccattttgggttcttaggtagatggaatagagtttccagacttgagggttttaattcagcaacccaggatcaacactttctaggtgtgagactttagtaaataatatactcagagattcatggtttttttttaatctataagttgcagaaaataatatcactatcatgcttttttaaaggattaaataagatatatttaaaaatttgttatccttatacctggcatagagtaagcgaacagtaaatggtatatttgtaattattcttttttacgttgctttctacttaatatgcgtttattaagcttcaccttaagtataatttagcaaaggattatttcagttttcccttaaaccagtttataagtttacatagggaggttaaagccaacaggaatttttatgtaataaggaaattcaaatatttcagtatctgtgataagagttgtgttaatttgcagaggaataacacaaaacattgattaaatttggattgctaaatgttaaacagtgtttgtacaataaaagtgtgattcagaaaaagccttattataacatgcggaatgtattagcactctttggagacttactatcttttaatttattttattaagctgctgttgtgagctaactaataacataagtgtgaactagtttgaagaagaattgcgattttattgaataatattctgcaagaattaaatatcaataggttagcaatatctcctcattgagttaaagtatatagattgtatacatgttctatgtatatactatatataaatgtttagatagtatatatgaatggcataattactataagcttacagggaaatatgcagagttgctgttatttttagaaagtaaatgatgacatttattttttatctaaaactttaatctgttcagtgatttagattcatttgagctctaatgatttggagagtaaggcacaggcatagccttaatttattggtgatgaaaaaaatctacttattggcaagatgggggaaaaaatcacaagccttgtatggaattgtatgattctgcagagttgcaatggtgttaacaattgtgacaagttacactttctgagacaatcttcaattttagcaattaaaatagcaaagaattattatttataacagtattcataacatagcaaatggtcatattccttatagagacagcacttccgagtagtctttattttgtttttcaaatttgtcctttcaatatctcaaaatatcttgtgttgcaattacatttccaagtatatatttggttgggatgaaaatagctgtaatagtagtagtagctaccatttattgaattcttgccacgtgcctcatattttatgtggtgtatttgatcttaggccttaggacaactgtaaaaggcaggtattgtagaagacaatgttttctgagagactgaaatgacaaattagaaaaaaagttaaagacttcttggaaatgctatctctataaggaatatgaccatttgctatgttaatactgttatgaataataattatttgctattgtaattgctaaaactgaagagtgtctcagaaagtataatttatttgtcacaattgcaactctgcagaatcacccaattccatacaagacttgtgattttttcccctaacttgccaataagtattattaccataataaatatgctgacgtttcaaagtttaagaaacttcctacagttctcacacgtagtggtgacaatatggctaaggggttaggaatgcccacatcctcctatgctgcatcctgcctgtggtttagatttgagatagggacccctactttctttcccctaagagcagatctgtgtcattggctataactgctttctggtcagccacatgacacgtggacttaacagatggtttctaataagattgaaagcatatcttgactccacttacctggccagcactggagaaaggaagattaagagagatttggatgagtgtccttgtcacataacttcccctccctagaaaacttggtccaatacgttgtaatctggtggtgcaaactcacaacttttcttcccttctgtgagtgtgtatatatgtgagtttattgtatgtgtgtgtaaggtgtgaatgtgtatgtgaagtctgtgtgtgatgtgtgtatatttgaatgtcctgtgcatgagtttttttgtgactgaagtgtgtgtgaggtgtctgtatgtgggatgtgtgtgtctgtgaggtgattgtgtatgaggaatgtacatctgtgtctgtggtatatagaaaacgtgtgtgtggtgtatgcacttgctgtgtctgcatatgcatgaattgagtatgtgacttgagtattgtgtgtgtaggaggaggggggaagtaaaaaggcaaggtgacagtagagactggacaaatgaacatagccgggcactattcctttaactcctagaacagacataacttgaagtgatctagacttgaactttggagtatgaagttccagccagctgtgtaactatctatttaatatttggaagcgcttagcctgcttaaatcttgattttatcatttctattagagaagttttaacttaaatgctctaaggtgggggtgtccaagggagaaaatacagtcatgggttcttagtttctgtttctggttgggccagaaaagctccttcctcatccctcttttccacttatcaacagagacagaagctaaaaaccatggcttctggctgctaaagcctaaaataaaacaaaacagaacaaactcatcaacaataacagcaaaataaagcaggttggaaatgactgctctaagggtgaagtgaatatgttcaggttggagttactgataagttgtaaacaattacaaggatgtaaaatattgcatatttttattagtggcattacttttccaacattacattttatattgaagttccagaacaacaaaaaaacactaaaggtattgcagtgaggaacttatcagtaagtgcttctaccttcaaggaattaagttaatttttattggcaatatttggaacattgtatcaagaagaaagactagctaacgaatctcttttgcacatcaagctcttacagtgttaattcattaaacaactaagacaattttaagtaggagctttggtctaagatgtgtggccgcaaactgaaccaatactgacagaatttggcattaatttttttttcagagaattttttttttaatatatggcaatggttgaaaaaaaacatagaatattgtagttcctcaaattgttaaacacagagttatatgatccagcaattctacttctaggtatatacccaaaagaattgaaaatacatagacaaatgttcacagcaacattattcttaatagccaaaaagtggaaacaatccaaatagccatcagctgatggataaacaaatgtggtatattcatacaatggaatattattcaacaataaagaattcagtatcaatgcatgctattacatgtataaaccttgaaaacattatgctaaatgaaagaagccggaatgacataatttcatgattccatttaagtgaaatgtccactatagacaagtctatagtggattaatgattgcctagggttggagggggtatggggaattgaagattgagggtcaaagggtttggggggtgtactgaaaatattctaaattgtgttaatggaggcacaactctgtgaatgcactaatgtcactgaattgtacattttaaacaggcagattgtgtggtatttcagttgcatctctataaaggtgttaaaactaaatatagaacaattttcctaagtagtggcccctcctcatttattggaccaatagtttgggaggaaccagtcatgaccttcctgatacaaatcaacacctacagataggatgggaggcaattgtgctaacaaagtacctcaaaccacaaagtctgtcagtaaactgatgcttttgtcaaggatgaatgaccaggggcaggtaataggtgagcaactctcaactcttttgtatatggtactatagtctggaactagcaagtactgaaaaacgctagatgataaaagtcattgttattttattcttccctctcccttcctcccctcccctgtgctccctttcctcttcccattttatttatttatttgagacttggtctggctctgttgcccaagctgagttcagtagcagtatctcagctcactgcaacctccgcctcatgggcttaagccattctcacacctcagcctccagagtagctgggaatacaagtgcatggcaccatgcctggctaatttttacatattttgtagagacggtgttccaccaggttgtgcaggctgggcttgaactcctgggcttaagggatctgcaggcctcaccctcccaaagtgctaggattataggggtgagccaccacacctggcctcccctccctttttcccctcccctcccacccttctcctctccccttctctctcttcccttcttcttctttcccccttttcctcttccttcttccctcctgtctttccctttccactcttttctccttccccactcataaatagatattataatgaattaatttagaattatagttaagcatacatttgaagtaattgttccaatttcataattttgaagtattttctgagaataaactgggcaaatgcagaattgggacaaatcctatgtgcaataattgctaataggaagtgttctgaagtatgaattctctcctcctttcttgtttgacttgtcactgaatctccagtcctacagagtactatgtcctgcttattgtttatttataccacaccccacttctacgtataaacatcactttcactacggtggattcaaatgatctcttaggaatttagttacattacagtctcacataaaattactgcccttaaaaacatttgtttgctgggcagggagtggcgaaaccccatctctactaaaaatacaaaaattagccaggcgtggtggcgggcgcctgtagtcccagctactctggaggctaaggcataattgctttaacctgggaggtgcagcttgcagtgagcagagattgtgccactgcactccagccttggcaacagagtgaaactctgtctaaaaaaaaaaaaaaaaatttttttttttgctaacattatttgaagaatagtcagttcagtatgcatctatgtagacctaaccaatagttgtattttacaagtttcagttttgaaatgttggatgatatctttcagtttaaaaaattagtatttctataaagtgtctttttttggatggaaatgtttctggaatgtgacacttaaattttaattactattattaaatatcaatggatttgttttgcataaccaaacagttggataagttcagtttatgtgctgtgcaatactaagatatttacttggcatggagagaatcactggcttactaaataaaagaattcagcattttgtttgtcaatcctatgttaattgcatttatatttctgacagtttccttgatggaattaaaaaaaaaaaacatgcaataagatctgaattgagtgttgaaatgagtgtttcctgagctccaattagtgaaagtattgagatttgaagaatggttgaggagacaaggttttataattgcccttctgggaaaaagaatgagtaaacaataaagtcttgagatctctcaaacaaatatacagtcataaggaaagtttaaaagccacagtgaaatgcacacctcttaattatgttaacattgatatctattttaaattgatatcaatattagctgtgaaagtttcgtatattttgcagggacaaattctcttagtgtactccaaatgcttattgttacacatcctgagcacacaacgcaaacatattgggcaagcaaagaatctaggctgatatgtgtgaatgcttatgtggcattctatcaaaggagatagatgtacataaggggaattatggagaagtgaaaatttgtctaaggttcattttttcagtagcttaattttaatagtaaactcttttaaggaatgaatggccacaggcagagactaatggtgtactttcagtgttctcagtgagtgcttcacagattaggtttccaagagaagaagattgcctctgaggaagaagagatggggtagcaagaggcatatatgagaccgttcttgggaccaacacctatggaggggagggaagaaggcagaattatgggaccagatagaagaagttggtctgcaatgcagtcttgaggaaggcctcagcagagccaatagacagttccgaagctggcatgcccttgagagttgtcctaaattcgggtgagagggttaggcctttatatccttggtcacttgatagtagatgctggaacaaaatggtgctctttagctaaggcaatttacagagggctgacagctgagagcacttgtagaatctaggaaaatgagtctttcattcttgaaggggaatcttcacatcatccactacaaatggtgctatattttggaaccagcagacactgagaaatgccaggtggatagaatccttccttcttttattctatctttttttctttctttctgtctcctaatctagtgcttctccaaaaatacttttaagaattagaattaggccattagttattataaggaaggaagggaaataatcattttcataaaactcagcaattcttttaatgtcaagatatggattattattacactcaacaattataattattaatattttccacggaaaagtttcatatattgaatgacccaagtactccatgtgaccttccctgtctatgtaagcctagcattctgtcagccaaataaaattttggaaggaaggtcagataaaattattttttcactcggtgttaaagaaaagaaaaaataaagaacatttattgagcatgcactaaatatgacataaaagatctttgttttctgtattagaggttgagaaagaatgaaacagtctattgatttgaaaagctttgctctcatttagcaattattattattattattattattattattattattattattattattgttgagacagagtctcactctgttgcccaggctggagtgcagtggcgcgatctcggctcactgcaagctccgcctcctgggttcacgccattctcctgcctcagcctcccgagtagctgggactacaggctcctgccaccacgccaggctaatttttttgtatttttagtagagatggggtttcactatgttggccaggatggtctcgatctcctgacctcgtgatccgcccacctcggcctcccaaagtgctgagattacaggcgtgagccaccgcgcccggccaacaattatttttataaaataaaagtttattaatgaatttatacaaatagcactttataaaaactacaacacattcatttgggctgggctgttgcctggttagtcacattttttcttctttatttagctattgcacagcttctgaggcaaccacaaaaacatcaaattatggagaagtgagtgcatagatatatgaaatcaacatttcaaattggtaatagaatgaccttacttattaagtagtgatcttttatcaagctgctacaataaaatcgaccataacattaaacatggtagatgttactaaccagaaatcttaggtatttaaagttatgtttacttattttttttaataagacttggaagtgtcacttaaatcacacttaagaatggatattggctaaaggctgctgagtcttttaagattcctgtgaatttttttcagattgttcctcagtcaattcaggatacttgtcattgctggctatacagcagagtgcagagttagcccttgcagacacacaaagataactcaaggcactgatttctgcatcttcagcctcctcatttcattaactattaaaattaattccctgtagagataatttgcatcaatcaacagaatagaagaattagaagagcttctgaggcttttctatgactaaaagagcaattcttttattgactaccataaacattagatttactaaaaggaaaaggtgttttaaattgaaccacccctctaatttattcatcttagttctgaaaacatgtaggtaagagttaatcatgttactgaatctaatttaaaaagtgagagggaaagtactgaatatttttcctctttgaaattacatgttgtttgcaatattagcctgcctgtatttttcatgtaaaccttttgtacattgaaaacaaattcaaaataaagaacgtttgttttcaggctcagaccttaagaactgatggtcttttcttttacttctacacaaaagtctaagcagttctgaagaaacactacagtgacattgggtcattgctaaaaaaaaaaaaaaaaaaaaaaaaaaaggttcacaaactatcaacattttaacaatctaatagttgattgttgtttcccaaattggtgattttgaatgattattttatgtagaatggaactgtgtctttttcttcattcatgcaacaaacatttcctgatggataccaagcaacggtgacaggtaagcatgccatcctagatcagtgttatataactcccaagcttcagtgaaggcctcatttttgttattacaaactgcctctctgggacctcatgaaggtactattcctgtttcgggaataggtctatccatccttgtctttttgtttcctgtcttgattctacaatctcccctttggccattaccatctcaaaatcctgcttcccaaggtaatccgtctagcttttctaatcttctggcttcccattactcatttcaattccttcttctggctccctgttgctttcctaaccaatttcaattacttatccttatcttgaaggccattcaccactctgccctgctgacgtgtttttcttatcacccaagattcctcccccggctcacacttctgcatgcaagcacgttcccaaagtatgaaaatgctttggatttatatcatgctgttgccttgaagagttttattctcttcctcatatcttctcagagaagaaagtaatttggctgtggttcaaaattcaccaaggcagtaaaatcttgtgttttgtacacaacttcctttctaatgacctctccctttcttcacctcacattgggcattcactcataactatttaagggccttctcttaggcggctgccctgttttcaggttgtgccctatgtggtcacaagtggctattcttaataaatcatagaatcgtagaatttaagtactgacagggatttcctatatataagaatccaacttcctactctgcagaaatccatctcagaacattctcaatgcttaaaattgccttttcgggagagaacatcaactcgtaagacaagctctttccttgttgcctaggactcatttttagaaaaatattctttgtaatgaattgtttccctgccacttcctccctttggtatgaggcatgttgccagaaagatacaaaataattctaataatctttcttagccttgataatgcaagagaatacagcaataatttcctccattaaaccttatttttttttttttttgaggttagatgcctaaattacttcaaggattcttcttgtggaagcatttttgagaattttcttgtctttctgcacctctgatttggtaacttgaccagcagacttcacaagaagcttgctgtcagtgttagtccaaacacaacctatcagttagtgtgtttagtcattaatatttaagagtgttttcataacctttaaattaataattagtcatctttattctttaatgactacagaagctcacattcatagtattttggtaactaaggtatccataggctcaaaaactcttcaaaattattgtgtaatgaaaatgttaaccatatttaagagagtgacttggaaaaaggccttgtttttcaatctcatattttgaagaactattgagatgtcactgaatagtatttttagaatttttgaattgctcacacatgagcacttggggaattggtcagtgaatatatctcctgagcactttgttccttgaaattatcaaatccttcttggaatttctttttctctctctcgtgatgtgtgggtgggactgggacattaccaacacaattagaacttcatttctttttcttcttagtgaaatttattttctaaaaggtttgtgtgtttcactctattagcagttctggaatcatccaagagtctaagtagatgtagcagagctcttatggaaactctggatatatacataatcacacagagaatttgtatttaattttagagttacatgtaccactggaatcacattcatatttctattacagtgtagtgattctgggttaagaatcactgatttagttctacctcattttacatataccttttcctgcaaagatatataaaaataaaatcatatgaataagttatgtgtttaatagttccattcagtcatctcataagacaaaattactttctaagttaattttaattcagatctttatagaatattgaggttttaaatgtgaacacatatatataattttatgatacaaccttttcttctgaatacttaaagtgttttcacagttggaagtatcaaaaactttgttctctgtaaaccttcagcttccatccttcttcagtcttatctgcagttatctcctgcacatgtaaatgatgtggtagaagatacggtttaagatgaattttagttatttaaagtgtgtcataacctgaacattttacagatatatttaaacaggtataggtatatttaaaatcactattttaattaaaaaaaaaaaaactttgaaaaatccctaatttcaaaaatatatttaaaatgtacatatatgaataatatatagagaaagataggaaatattaccatgaattatacagacctcagtttatctaaatttacagttttaaaataataatcttatccttattatctgaagatgtcattgatgatatgtttcatttttatatttggctttagtttaccaatattaacatataaattattaaacaattgtacaccagctttgtggtctctcctttgtcatgtgtgatttgtgtaatttgatgaacttgatgaaagcttccatttcaacttgaaggctgtgaatatgccagattatgtgcattttgtagtaaggattatggagctgaacaagtatgacagacttgttaaatatgttgtctacaaatttttttttgtttttgtttgagatagagtctctctctgtcacccaggctggagtgcagtggcgtgatctcggctcactgcaacctccacctcccgggttcaagcgattctcctgcctcagcctctcgagtagctgggactacaggctcgtgccaccatgatcagctaattttttgtagttttagtagagacagggtttcaccatgttagccaggatggtctcgatctcctgacctcatgatccgcctgccttggcctcccaaagtgctggaattacaggtgtgagctaccgcacccggcctattgtctacaaattttatcacttttggtaagaaatgcacaaagcctatcatgatgtcattgctagtttatatgtttgtgaattttaagccaaacaagcgttcaaaacgtttgccacaaatcgaggacctaaaacccagttttatatataaagatatttaaaaacatatttctggagaactatgcatatactaccaacacttacaaggcaaattaaattaaaaatgttgtataaggaatataatattttaaatttttagtgtaatcaagaaaaagatacattgttttatcaattgattaatttattggtcataggatttggcctatttatatttctgagtatccaacagaatcagtcccttaaaatgctgaatatcacaatttgcagttcggctaatacatttatatccattttattacttagttgtaatataaaggaagttacctcttcatatcccagggaaactatggtagttgacaaggagtgggtccaggctttataccaactgatgtcttatacaactcgaggagtcccttttaagagaaatggatacatcattggaatatgtattgaatgtggagattgaatatttatttaggatgtaaaactaaatcacaccagattataaaattaataaagctgacaaattctacaaggataacaaaatttataaaattaacttcattttcagaaaattaattgcttgatacatttctatgatttttttggctctgtagttttggttgcttattctctgattgcctcttcattttacatgattctattatgttttctatgttgagaataacaagataatgcagtcttttctctagtataattgattgtaatctgtcattttattaccgatagtttagaaaagttacatcaagtttctcaatttttgggggtgatttcatatacattcttaggactgtgaccaaacttgggaaatatctctatcaaatgtctttcatttgtgaactgtaagatttggaagaattttcaaagagcagttcctggctttatatgttttgaacattgtgtctccttcactccacacagacttgtggtgcctgaagctctgggcacattgattttggagtgatctctgggcttgcactttcatgttaccagcaccatggtaatcaggtgtgttcgtggaagctacacccagacagccagcaagaacctaagggtacagggaagagactgagaaccacaagaatataatcacaccaaactgaaactaaatgaatctttaactcagtttctaattagccagatcccaaaatggcccacagtcaccccagtgctaactaacccaagggaaaagtgtgatataggcaaaatcagtacgtagacattgatcttaaacttctgcagttaaaatgtctcactcatgcaaaattctaaaagcaaaggagcatgccatcccacccctcgagccttttccagtgccttaggaaggagcttgtgcaagtgaggggccctgaagcttcacccttcctagcctcacggtaaatccacctctgtggtagacagaaacatttctagaccacaggaaatctgtttgcctaaggaaacacagaagctgtccttacagttaaacagaaatagttctatttttttcctagagttcagcaccatttctcaaggggtatttcttagaagttcattttatgaagtctcctccacaagttctttttgatagccaataattcaaatgtcatgctacttctttaaatcactccagtcattgaatagcataatcttttcagggggcaaacagctgggctccagtaggctttaaatgttcatttgttttccaattttttgacttgcataggaagaagtaatccctttcatgtgaaatattcccctcgattaattttaaagaaccaatggcattgtctgataatgggatgaaagcccaattcactgaacagaatgtgctatttgtaacctggattatcctttaggtttttcggcatagtcctcgagaagctgagaatctgtcattttattgattaaaatacacgtacagatacacacgtttacattagaaataaaaatgttgtaagctcaaataggcagggtatttcacctgaaagcctgaaataaatgtgatgagaacctatgaactaagttccagtgtaaacaagtgggttaaattctcattatagaaacttccagtgagcaatgcagcatgactgtgggaccataattcaggaacaatctgcagagcaaaatatagaggcactaattttgttatatttgcagcccacatactgtaataccagatttgctcctgttgttctggccaaagatgagtcaggtacctctgatataaccattcctaaaagacaacaatggattcagaatgtgagactgagagaaatcctagaagtctgaccttcagatcagtttaactgtagatcaataatccattactcagaccaacacagtaccaaaaaatctcttcagctggctgccaaggtactattttatcttaaataagctggttgagagcagtcaatatagatacatttttcccactgacaatttgctgattcagagaacatgcaacatccagccacgaaatagataaagctcaggcctgccctgtagaatatggtcacctggctttcctgttctcctacaaatgtcctactggaagaatagcccttaatcccttaatgttcatctaaaccaaggcttgttctaaattctctagactctatctcatgcattattacatctctcttggcatacttctcttcttgaagtgcataacatttatataccttctacaaatgttggtattattgatattgagggagggggcagacccaggtctatggccttatgtattattagtgaattacaatttcttagagtaataggccaatgattaaagtcacatgttaggaaaactttaatccactagggaaaacttccaatatttttcaaagtaatttactacatttggatgcaaattatataggtgtttttggtggtatccatacttgctttcttgtcaacctgaagagatgtaaatgtaaatcgatgctaattgtaccgtgcttacacaaagagctaatttgagtaatatcctatcccatcagttcattttcaccatacatttttttctttacaaaattgtttttaaaactccactggaaaaaaatatataataaactacatgtaaattacacaatttagtaaattttgatataggtatacacatctgtgagaaaattaccaaaactgagatagtacacaaatatatatcacccccaaaagtttcctcgtgtctttgtcattccttcctccagctttttcccagaaatttcaccttcctcaggctgatcaacactcagctgaagactcaagagggggcctgtgcagatgtccctgagttccctctctgggccactgtctcctctcttttcagcaaattctagttaccttgacctccctgaattcccagctccatctcctcaacttagggagactttcaggtcaggcagtgatccctcctccttatgctgggacctggaagctctccagcatgtacactggggcaaccataggcgtcatctcattgtattcattttctctaatcaccatgctaagctaactgttgcctaaggtctgaaaactgttgtttcattcattttgtccagtttttccattctttcatgagcaagcataaacctgactcctttgggcaagaagcagaagtccctatagtgactttatttactttattgttattgtcagcatttggaaaaaaaaatgtagagattgactattttatactatttaagtaattttttgttatattgattttacctaaacaagagtttattagaagtattttgttatacagcttataacaaataattgtacaaaaattagaaaaatcagatgaacaaattttttataagacttctcgtggttatagaatgactctaacaccttgtagtgtattttttaggattttgttcttagtgcatgtgttagtctgttttcatgctgctgataaagacatacctgagactgggaagaaaaagaggtttaattggatttacagttccacatggccggggaggcctcagaatcatggtgggaggtgaaagacacttcttacatggtggcggcaagaaaaaatgaggaagatgcaaaagtggaaacccctgataaaaccatcagatcttgtgagacttattcaccaccacgagaatagtataggggaaacttcccccatgattcaaattatctcccaccgggtgtcccccacaacacatggaaattatgggagtataattcaagatgagatttgggtggggacacagagtcaaaccgtatcagtgtatatgtttagagggacatagaaaactatataagtttaataagaatatatacatattgttattaaatgaaaacatttgaaattataaaagtagtaaatattttttagtaaaattaaatatatatatagtaaaaagtgaaagctgttttacttccattcccagagaaaactttacttaaattttatatagttttttccagagttcttcctacacctgaaaaacacagtggattatttttgtgtacaaaagaaaagaaatcattctatatgtatctcctttacttccactctttttctttccacttaattcatacagataaactttaccatttaaatggcctctggtgattcctttataagaatgaaccattagatagttaaccagtttactaatgacagacatttatattgctcccaagttgttgccattgttcatttatttatttctttagtattaattcctagataagttgctacatcaaaaataatgtacatttaatattgcaatagttacaaggaaatctgtacttttttcagtaatatattagtgtctactttcaaaaagctttaaattctgagcatcatattgtcttctaaatctttgacaaaaattaatgtaaatgaatatgctattttaattgtcatttatttatttgattattagtaagatttagatttagatttcagtctttttattagccatttcagagggatgagcattctctgcctatggactttgcctggttttgtattgatgtgttcattgttttcttatttcctcatttgtaacatcattttaaagtgcttttatttctggacaatgtttttacattttttaagactcctattgtgatttttattaaaacaaagttagatctatagaaaagctggaaagaatttgaagttttaacgatattcgctctccctttccagaatatgtggcaaaggagggaaaagaagggattctgaaggaacacacgggaagtcggcagtgtgggagtgatggatatgttcattcccttgcttgtggtgatggtctcactggtgtatacatttgcagtaattgtcaagttgtacactttaaaatatgtgcagtttattttatctcagttacatctcaatgaaactttttttttaagtggcaccaaacatacattaaatagctttcagccaaaagtaaaaactgagtttggtcagaatatttttgtgctattttggttagatttcttctgtcacagttataatggctttctaaaataaactaggaagccggagaaagtcactttaaccttcaagagtagggaaactgaacccataaaaaaagtgcttccaggtcagactcagcctaaaaaacctgaaaaataaatgtgacttctgagtagcagtatatgggaaaaattttctataaatctctgagaatgaagttgactggagactacacaagagacaaagagatatagaattgccttaaatctgaaccatggagttacagaatgataatggcattatgataaatttttagagaacactcttgataaacaggcacactcaaaaatagctttttgtttgttgttgttgttgtttgttttctgtgcaagaggtgacaattgaatgaggttccaaaaagtagtgtgggcttgcattgcacacatattatcaggcaggatttgtgcagtagagaaaggtgactgaagaatgtagtggaaggacatgctactggaagaagctgccaagtgacatacacagggctgtgagtcagccagggttgaggctctgtccagtgggacagcaggctctgtctccacagtggggactgcctgagagctgggtgctctggttcagccattgtagcacaaaggcacttgtataaatttccgtgaaatggcttgaaacctactttgccataagaatgagataaatttttaattcaaaacttaaaatatcttgattagaataaggaggaggaagagaaagaacaggcaataaaaagttatttattgattgattgacttaatgcagctagctgaagggtgagaggaagaactccggctccagagtctgaaagccagggctcaagtttcaatttgggcatttcccagctttgaacaacagaaaaacactgtttaccttttcagaacctcagtttccttagatctgtaaattagcaataaaaactaatgtgccttccaaggttatggtaaaaatcaaatatcttatgcctgtgtaaatctttttcaaaaaacaatagacactgcaaatattgggcattcttatgatgatgtttattcttcactgggagcattgatggattgattgttacttttcaataactttttccatatttgctctagttttaaatttgcaaattttaattcagtattgtttataataagacaaaagctcttctttaaggttggggcattaatgttaaaaaaaaaaaaagaactgttacatcaaatgtacatcaaatgcagtgactggacaacaaccaaagaaacttcctgtgtaatccccatcccatcacacacacacacacacacacacacacacacacacacacacacactatagacactatatttaaaattggcaggggtgatattatgaactcctgtaaaaccaaattgatttgtgtttgtcaggaatgtgtgggtctgtgtcctggaatgctatatatttccactgtgcactgcccattgaccatttctactaggatgccttgaaggcacctcagactcaacaagttcaatttgaaattcattatgtactccccagttgttcacgctaggagccttcaggccacccgtgacttttctctctccttgagtctctccttagcttcccatggatcagtctctgtaccatgttgattctaccttctgagtatcctttctgctctccctcatctgcacttctgttaccactgcctgagttttggttatgggcttcttagtcttttagtcttttctctcccccaacccagccatcgccaccagcaagaactatctttctaaagcaccaattatctttccaaaacagaagattttctcttctttgtaggaatttaactttagggcatagtcagataaattagccaaaatatatgtgaagaagctgttcatcacaatattgtttattatagtaaaaaaaggaaaaaaaccttaatatctcaaaaatggatcagtaatatcgagactatacacaatagtcattacattggtattatagatgtataataatttggaaatgatattataaaaaattattaaataatgtgcatagaaaaatttgtggaaaatgttttatgctataaaaatatttctaggtaatggaatttagtaagaatttttctcttcctacttcccaccaaacaaaagcaaaataaaactaaaatagaacaaaaattctgctatgtagccctttacaaaagatagtgcttctggcaagaaactgtgactgaccaaaatcctgcaattcagtacctgtgaaatgccatataacaaatttactcatatcctaaaagttatgagaactgggggcttcaggacatctcatacctgcctcattttttcaagaaaatttgttgtagaatcttttatataaaacactatacactgtccttaatccactatgtcctattccctctatttacaaatgtgctttgtccttacatttctttaaaaaaaaaacaacaaaaaactgtgttcacacgtatctttgtaggctaaagaaaagtgatactataaggattgggaggtagagggtgggggcactgaggaagccctgctgccctcaggttaagctccgtatctctctcatttaaggtccctgataggagttacttgttctcaaacatgtgtgttggctctttactgtcttttaagtagcatttatgatgaattccctttttttaatggtggtattacagtatctgatgttaggcatagaactgctcaggcagcaagtcaccttttctttttccccttttttgatagacttgagagaccaaggcagcacacacacactcctccaactagctttgcaatttgcatacatttcgattctggtggtctattcatcatttttatagaaatgcttttatgaaattcgatctcatggagtgagttaggagtttctttgttttttgctttatgataacccattgcctcagtaaatatcttaattattcccagaaaaaaataaacccaactgattagacctaatcccttctcaaatcactttactttctttgtcatttcctatccatcctctctctacactcagatgtctttgttttattatgaaatatatttggcatgagtaacaacattaagtaatatgaatcattttatttggttaaatgtctacactcaaagattagtggagaatttggaaaatataacgaaataatactggaacttttgatatttccctagctacttgccatattcaaaagatgtgtctttgaagtgaagagcagaatagtaccttattatagtccatattaaatcatatttatggctttcaacagaagtattgaaaaccagattcagttgctgcacccatcaactcatcatctacattaggtatttctccgaatgttatcccttcccttgcccccaaccccccgacaggccccagtgtgtgatgttcccctccctttgcccatatgttctcattgttcaactcccacttatgagtgagaacatgcggtgtttggttttcggttcctgtgttagtttgctaagaatgatggtttcaagcttcatccaagtccctgcaaaggacatgaactcatttttttttttttatgtctgcaaagtattccatggtgtatatgtgccacattttcttcatccagtctatcattgatgggtatttttgttggttccaagtctttgctattgtgaatagtcctgcaataaacatacacgtgcatgtgtctctatagtagaatgatttataatcctttgggattatatacccagtaatgggattgctgggtcaaatggtatttctacttctagatccttgagaaatcgccacactgtcttccacgatggttgaaccaatttacactcccaccaacagtgtaaaagcattcctatttctccacatcctttccagcatctattttttcctgactttttaatgatcgtcattctaactggtgtgagatggtatctcattgtagttttgatttgcatttctctaatgaccagtgatgatgagcttttttcatatgcttgttcatatgcataaatgtcttcttttgagaattgtctgtccatatccttcgtctgctttttgatggggttgtttgtttcttgtaaatttgtttaagttccttgtagattctggatattagacctttgtcagatggagactgcaaaacttttctctcattctctagcctgttcactctgatgatagtttcttttgctgtgcagaagctctttagtttagttagatcccatttgtcaattttggctttcgttgccattgcttttggtgttttagtcatgaactctttgcccatgcttatgtcctgaatggtattgcctaggttttcttctagggtttttatggttttaggtcttaagtttaagtctttaatccatcttgagttaatttttgtataaggtgtaaggaaggggtccagtttcagttttctgcatatggctagccagttttcccaacagcatttattaaatagggaatccattccccattgcttgtttttgtcaggtttgtcaaagatcagatggttgtagatgtgtggtgttgtttctgaggcctctgttctgttccattggtctatatacctgttttggtaccagtagcatgctgttgtggttactgtagccttatagtatagtttgaagtcaggtagcttgatgcttccagctttgttttttgtttgtttgtttgttttttcttttgcttaggattgtcttggcaatacgggctctcttttggttccatatgaaatttaaagtagttttttctaattctgtgaagaaagtcaatggtagcttgatgggaatagcattgaatctataaattactttggacagtgtggccattttcactatattgattcttcctatccatgagcatggaatgtttttccatttgtttgtgtcttctcttatttccttgggcagtggtttgtagttcaacttgaagaggtccttcacatcccttgtaagttgtattcgtaggtattttcttctttttgttgcaattgtgaatgggagtttgctcatgatttggctgtttgtctattatttgtgtataggaatgattgtgatttttgtacattgagtttttatcctgagactttgctgaagttgcttatcagcttaaggagtttttgggctgagacgatggggttttctaaatatacagtcatgtcatccgcaaagagagataatttaacatcctctcttcctatttgaatatattttatttctttctcttgcctgattgccctggccagaacttccaatactgtgttgaacaggagtggtgaaagagggcatccttgtcttgtgccagttttcaaagggaatacttccagcttttgcccattcagtatgttgttggctgtgggtttgtcataaatagctcttattatttcaagacatgttacatcaatacctattgagtgtttttagcatgaaggagtgttgaattttatcgaaggccttttctgcatctattgagttgatcatgtggtttttgtcattggtttcatttatgtgatgggttatgtttattgatttgcatatgttgaactagccttgcatcccagggatgaagccgacttgatcgtggtggataagctttttaatgcgttgctggatttggtttaccagtattttattgaggattttcacatcgatgttcatcaaggatatttggcctgagattttctttttttgttgtgtctctgccagcttttggtatcaggatgatgctggcctcataaaacgagttagggaggagtccctctttttctattgattggaatagtttcagaaggaacggtaccagctcctctttgtacctctggtagaatttggctgtgaattcatctggtcctgggctttttttggttggtaagttattaattactgcctcaatttcagaatttgttattggtctattcagggattccacttctttctggtttagtcttaggaaggtgtatgtgtccaggaatttatccatttcttctagattttctagtttatttgtgtagaggtgtttatagtattctctggtggtagtttgtatttctgtgggatcaatgatgatatcccctttatcattttttatttattgtgtctatttgattcttctctcttttcttcttcattgatctggctagtggtctgttttgttaatcgtttcaaaaaaccagctcctggattcattgattttttcaaagggttttttctgtctctgtctccttcaattctgctctgatcttagttatttcttgccttctgctggcttttgaatgtgtttgcccttgcttctctagttcttttaattgtgatgttagggtgtcaattttagatctttcctgctttctcttgtgtgcatttagtgctataaatttccctctaaacactgctttagctgtgtcccagagattctggtacattgtatgtttgttcttattagtttcaaagaacttatttatttctgcctttgtttcgttattcacccagtagtcattcaggagcaggttttttgattttccatgtagttgtgctgttttgagttagttcttaatcctgagttctaacttgattgcactgtggtctgagagactgtttgttatgatttctggttttttgcatttgctgaggagtgttttatttccaattatgtggtcaattttagaataagtgcaatgtggtgctgagaagaatgtatattctgttgatttgtggtggagagttctgtagatgtctattaggtccacttggtccagagcttagttcaagtcttgaatattcttgttaattttctgtctcgttcatctgtctgatattgacagtggggtgttaaagtctcccactagtattgtgtggaagtctaagtctctttgtaggtctctaggaacttgcattatgaatctgggtgctcttgtattgggtgcatatatatttcaggtagttagctcttcttgttgcattgaaccctttaccaatatgtaatgcccttctttgtctttttctgtcttttttggtttaaagtctgttttatcagagactaggattacaacaccttttttttttctttctgtttgtttggtaaatcttcctccatccctttatttttgagcctgtgtgtgtgtttgcacatgagatgagtctactaaatacagcacattgatgggtcttgactctgtctagtttgccagcctgtgccatttaattggggcatttagctcatttacatttaaggttaatattgttatgtatgaatttgatcctgtcattatgatgctagctgtttattttgcccattagttgatgtagtttcttcatagtgtcagcggtctttacaatttaatatgtttttgcagtggctggtatcagtttttcctttccatatttagtgcttcctccaggagctcttgtaaggcaggcctggtggggacgaaatccctcaggatttgcttgtttgtaaaggattttgtttcttcttcaattatgaagcttagtttggctggatatgaaattctgggttgcaaattcttctctttaagaatgttgaatattggcccccactctcttctggcttgtagggtttctgcagagagatcagctgttagtctgatgggcttccctttgtgggtaacccaacctttctctctggctgcccttcacatgttttccttcatttcaaccttgatgaatctcacgattatgtgtcttggggttgctcttctcaaggagtatctttgtgaggttctctgtattttctgaatttgaatgttggcctgtcttgctaggttggggaagttctcctggaaaatatcctgaaaagtgttttccaacttggtttcattcttcccatctctttcaggtacactaatcacatgtaggtttggctttttacatagtcccatatttcttggaagcttttttcattccttttcattctttttttatctaatcttgtcttcatgctttatttcattaagttgatcttcaatctctgatatcctttcttccacttgatcagtttggctattgatactgtggtaagcttcacgatgttctcgtgctgtgttttttcaactccatcaggttatttatgttcttctctaaactggttattctagttagctattccactaaccttttatcaatgttcttagcttccttgcattaggttagaacatacttttttagcttggaggagtttgttattacccaccttctgaagcctatttctgtgaattgatctaactcattttctgtccagttttgttcccttgctggcgaggagttgtgatccttcggagaagaagaggcattctgttttttggaatttccatcctttttgcactggtttttcctcatcttcatggatttatctacctttgttctttgctgttggtgacctttagatggagtttttgtgtggtcatcttttttgttgatgttgatgctattgctttttgtttgttagttttccttctagcagtcagacccctcttctgcaggtttgctggaggtccactccacaccctgtttgcctgggtatcactagcagagcctgcagaacagcaaaaattgctccctgctccttcctctggaagcttcgtccaagaggggcacccaacagatgccagccagaactctcctgtatgaagtgtctgtcaacccctgctgggagtatctccctatcgggaggcacaggggtcaggggccaacttgaggagggagtctgttccttagcagagcttaagggctgtgctgggaaatctgctgttctcttcagagctggcaggcaggaacatttaagtctgctgaagctgtgcccaaagccacccctccccccaggtgctctgtcccagggagatgggagttttatctgtaagcccctgactggggctgctacctttctttcagagataccctgctcagacaggaagaatctagagaggcagtctggctacagcaactttgtggagctgcggtgggctctgcccagtttgaacttcctggcagctttgtttacactgtgagggaaaaaccacctacttaagcctcagtaatggcggacacccctccccacaccaagctagagcatcccaggtcgacttcaggctgctatactggcagcaagaatttcaagccagtgtatcttagcttgctgggctctgtcagtgtgggattcactgagcaagaccccttggctccctggcttcagcccccttccaggggattgaatggctgtctcactggtgttccaggtgccattgggttatgaaaaaaaaactgcagctagctcaatgcctgcccaaacagccacccagttttgtgcttgaaacccagagcccttgtggtataggcacccaagagaatctcctgatctgtggctagtgaagaccgtgggaaaagcatagtatctgggctgggtagcttcgttcctcacggcacagtccctcatgacttcccttgggtagaggagggagttcccgagccccttgtgcttcccaggtggggagacgccccaccctgcttctgcttgccctctgtgggctgcacccactgtctaaccaggtccagtgagatgagctgggtacctcagttggaaatgctgaaatcacctgccttctgtgttgatctcactgggagctgcaggccggagctgtttctatttggccatctttattctcttacaattgaaaaataatgatcttaaaatttttgtctccacaaacaaaagcaagtaaattatctcagtaatatagttttaagaatagttgctcttttttaactgttggcaggggcataagggataagagaagaaatagttaagaacacaggtgggttcaaatctactctctggcacttactagctggggaactttgggcaactcacctaaaccatttaagcactactagttgcctcttctggaagatggcagttgtaataatacataattgatagtgtcattatgagataaaatgacataatgcaaataaagttattggccatgtgcttggtacaaaataagtactcaaaaagtacttcaaagtaattttttattctaggagccattccttacaggtggaaaaattgtgccttttgcttacattttactttgcatttcacaagatgtcttcaagagtatgacctcattttatcccttccacaaatatgagacatagaaattgttagctacattttctagggaaaaaaaaccgagcgtcaggaatattaagtgactcagccaagggtctacacctcataattagcaggatcaagaccaatgaaagtgcctcttggtaagatcatacctgaagctaacagacacgtgcaggcctcctacaacataggtagccatgtttagtgtaggcagcagttggacttctgtatattcatttctggcactggagactgcttctattatagaagttgtgaccttgtcactcatcaagcagatggcattgcttgattagagtcaggccatatttagaacatttctataaagccattctcatttgggcaaacatttttgccaattgaagtgtttcttttcactaattgagcaaacaaatcatgggctatccactcacaagggctttccaccacccatattttcaggaaggcaggtgttgagcttatattttcagaatatatttccagcttcatacactcttaagagaacattgaagcctctttgatgaaggtgagggtctataaacatgcttgtattcattataaggggattgtgattgtcctcatagaaaaatgactttaagaaatagatgtatcctgaagcaagataatatgagtgtcaggctggacacgtaaaatacaagggaaggtagtggggaaaaggctgagaaaagagtactgtagactttacatcacaatgcttaaattaatctaaaatgtaagctataaaatagactaaaattatatatagacgtatgtgcgtatgtgtgcatatgcataaaagtgtatgtatctccatacttcaaaggctaatattcacagatagattcaacaatcaaatacggagttagttttgaaggaaaagccaaataagacacctttgctagactttaaaattttattttaactgaaactacggtatagacataaccatataaactaatctatttacttgtaaaattaattgtttcattgtcattgaatcagatgtgagtgtatttagataagtcaaggtagtaaaagagtataataagaaacactgagacccagggatcatgctaactcagacttctgtcttgagtctgccacataagagcaatatttcctcaggcaaattattttcatagttttgaacttgaaattctcatctgataaatggacacaccaatgcctaacacatagggtagctgtgaggattaaatgacatgcgcaatttgcatggcttcctcatcaagttgccacttgtattagtcggctagggctgctatagaaaataccacaagcttggtgccttaagcaacagaaatttattatctcaccgttctggaggctaggagtctgagatcaaggtgttggcagggttggttctttccgagggctgtgaggaaggatctgtttcaggtccttttcttagcttgtagatggccttctctctgtattttctcttcgtcttctctctgtacatgtctctgtgtccacatttcccttcatgtctctgtgtccaaatttctctttgtcttctctctgtacatgtctctgtgtccaaatttcccttttattacaaggacaccagtcacattgaagtagggtgcatcttactcctatatgacctcatcttaactaataacatctgcaaaaaccctatttccaatagggtcccattctagggtactgagaggttaggcttcaacattaattttgatagggggacacagtacaacccataacaacactcagaagtcactttctcagacagaccatgcttgaccactgatgtagtttggctgtgtccccaccaaaatatcctgaattgtagttcccataatccgcacgtgtagtgggagggaccaagtgggaggtaattgaatcatggtggcagttacactcatgctgttctcatgatagtgagtgagttctcatgagatctgatggttttttaaggggctttcccttttttgtttggcacttctccttgctgctgctatgtgaagaaggacatgttagcttccccttccaccatggttgtaagtttcctgaggcttccccagccatgctgaactgtgagtcaattaaacctctttccattataaatcacccagtgtcaggtatgtctttattagtgggatgagaacggactaatacaactaccttttctaagaacagtcttaccctttcctagcacacacagtcccttgccctatataatatgccaaagtaaatcatagaatcatttattttcttattctttttctatcccccacactagtctgaagtccatggtgccagggccctacttgtcttggaggttgttctattctgggcttggagaacagtgcctggtacaaaatagatccttaacctctggcttgaggttagggctcaataagtaataggtggtataagtatctaaaaaagaatctcattctctatccaaattggtattcactagccatatgtgaaagaaactaaattttcaattttattttaataaatctaaatttaaatatccattagtggctattatattggacagcacagatatagaacatttctgctactgcaggaagttctatgggacatttctagacatagaagcatagatgaggatataatagtgataattcagttcagacccggtgctgcctgccaaattccacaacactgccctgcattgctgccctctcatgacaccacacagctcccagttgatttgttcttctttatggtaccaggtgtattgggtgtattgcaagcattttcttcttccattattaagttaaaaataccccttgaagttttgaaaagctgtaaaggggttgtcttgagagtcccattaacatttatagtgaattctgtggcagcaattttttattttaattgttgttgtctttgctattcagataagtaagcagtaggcatagataattaatgtacagattctgttttacacaactttaagaatgactctttgagaaacatgtctttaaggacaatgaactgagatatcccttacttgaggataaaatatgggtgcaggtacaaggagtcagcaggtgtcacgtgtgggctcatttcttccctcaaccctggaaagtatatagattctcaccatccttgttcagcctctgccttagggataagcagtgctggggtgattttatgctcaggaagtaaccaaaggctagcaaacatctctcattgttggcagtaaaaaccattgctatgaataacaatctatattttataaaactattttggcttcacataaaaatctgatgcttcaaggaacatactccaatgtgccttgaagtatagcacatactccaatgtgttactgaatcctgaaccacacccctaaaggaggcattcattgatatcactggcttaacaaaaggctttggggtggggtgaagggataatacataatgcagttagaaagtgatagaaagcatattgcttatataaaattcagtgctaggtaagaataaaatatgaaatacatgtggcaatgaacttagaatatgctccagttttggaaaaagaatagtaagataaaaccctagaatttggaacatttttaaataacctctattactatcattttaatctttgaacagtgacaaaatatcccacctgctttgtgacttttctgaaaagaatacatggtcacagggtattctctattggaataccattcacaccttcaaacttatcaccatccagttaaatttgaggaatggtaattgatgaccttaagtgagtcaagtcacaattacctgaagaactaaaaatgctactggaaggactagactctaagttggtacctaactaattcttattgcctgaatgtggttgtagagtagacccttcattaggaagtgaataggggaagtatgaaaaattaaatgtgtacaaaatccaaagcttcctgataggtcttttgggctattttgaagaataagacaaacaacagaagcattataattggaggattatagagccaacaaaggcaaagtaggagcatatttatcagacataataaagacagaaattaaagatcttatttatgtttgaggcataggaagcaatagaagcatatatatttgcaaggtctagacatgcctctattcatcaatgcattttagtattttagctcagcgttcattaaagttattaccttaatttatttaatcaaaatattgactctattctcatactgcaaataacttgttacatgatttggatgttaatatgatttttttaccactgaaagttaaactaatgctcatcctttcactattaaaatattaatgtcttctattttagtttagcatttaaaaaacaaatttgtagagatgggatctcactgttataaaaaagctttccatttttgtaaactgcaaacttgcagttagcttaactaaaattacataatagaatttccaaattaagaaattaagtcactcatttgttctgtaaagcagtcacccttgaataaagaaatgcatggttcaacatattttttaagaattcaatagtactttcagctttattgggatataactgacaaattgaaattgtatatattttcagtgaacaacttgatgttttgatatacacataaactttatgaaatgaccattaccatggttccatataaccattgtgtttaaaccatctaattctcttgttgactttcatttaaatgtttgatgtatagaaacctcatttcattaaatacttcagaggccaactgttattttatagaatccaacaaacattactttaatgttaacggaccctaaaatggaaaccaggcattggttttttttattttgttttgttttgtttttttgagacggagtctcactctttcacccaggctggagtacagtggcacaatctgggctcactgcaagctccgcctcctgggttcatgccattctcctgcctcagccacccaagtagctgggactacaggcgcccgccaccacgcctggccaattttttgtatttttgtttttttagtagagacggggtttcaccgtgttagctaggatggtctcaatctcctgatcttgtgatccgcccgcctcagcctcccaaagtgctgggattacaggcatgagccaccgcgcccagtcattggtttgtaatgccataaagaatccatgaataatatagtcgtgtatttatttttgaaagagaatgttcttttaataaagcatatgttttctaatttacacttgagcaaacctttattttaaagaaaaattgagaaatttatgtttcagagttatgagacaccgtcttcttatctaagatatgaaggatgcagcaataaattatccagatgttttggctatagtctttttttattgttgagtaacaaatttccatacacttagcaacttaaaacaatatccttttttttttttaatgtcgcagctctttaggtcagaaattcaggataacagggctggtttatgtgctcagagtctcaaactcaaggctgaaattaaggtgctaaccagctgtgatcttatctggaatcaaggtcatctctcaagatcattactgccactgttggaagaattcagtttcttgcaattataggatagaaatccctcttcttttgctagctgttggctgtagccccctgtgaccttctagaggccactcttggattcttatcccattggtcatcttcatctcagccgtggaagacctcccctctcacacttcatctctctgacttccttttttgcttctagctaaagaaagcactctgcttttataggttttataggactcatgtgattagattagacccaccctgataatcttatcttaaggtcagctgattagtaaccttaattgcatctacaaaaattcctttttccatgtaaagtaatataaccgtggagtaacaccagggctgagggtaataggagtcatcttagaattgtgtattagccaagatgtggaattcctatcaataaatttaagcagtgtttccattatatttgaaaaggagagaagattagggtggctgatcatcttgtatttaaatgctaagaaagacaataatcacagccaaaaagcttggtcacatgttgactttttaggaactcaattatagcaatcagaattgatagaggcagaaatcatactgcaaaggcttaaaggaatgctaagagttctaccatttgagaaataaagaactaccaggcaaaatgaagaaataaccatgtaattgaaaaactgccagaaataattcttaattagatgtagaccaaatgtctcaatagttggataacaaggcagaggccacataattcctctgtgcatcagtctgctcagacattctcatccattgcagattaaagccgagtactaccacgtttgtgccacagcgtctctgtggcctcctccctgatggctgcctgggaacatgttcctcactgcatcacactgcccttcccagtctctcaggaagcttaaaggggtaaagcaaagggaggagactgaaaaaaaaatgacaaattcgggagaagatcttttaactttctgttcattaagtgagaatttgtagatagagtggaaagaaccattgtgatcggggcaggagtatgtgaaggaaaggagggatagactgaagatgtcagagacagagaaggccccaaaggatggaacaggggatggaattaggagaaacgtcctgaaggatagaatggggatagaattaagagcgtgcatggatccatttagtctggaaagtgaaaatcttatttttctgaaatacaggaaaagaacagaaaatgagtagtggtttcaaatgagggagaaaaagcaattacatgtaagaaggcttctatcctctcaacacaacggggctgctttatatatattttctcttctgtaaagtgataaaaaatagtaaggccaaataatatttatgatagttaactgatatgatgcatataaactgcttagagtagcatataccacattataaatgcacagaaatgttagctattttttactatcattgccattattattttctattgacagtaaaggaaagtgaggtaatgttgtgaatttaaaagtaacataaagcttttcaatcacttgttaaaaatagcattgcagagaaacattgaaccctccttaaatgtaaatagcacgattcattgaacatctagtcaagatgactaatctttttttctagtaacgctcaacagtctagaaggtacagaaggcggtgggtatcaaggtttataaaaggtcaggaattggaactctggggacctggttgttctcatgagggcacataccaagatcagggtgagctaggaagtttaagtgataggaagataatagatttatttagagaggggaaattgagacagtttcaagcctcggagatggaacagaacaacagagctccaagcactgggatgcagggctggaggtgaccaagtccacgactttgtctttctaaagtgaagtggaggtgagtctgaagaaattatcactgtgattaaggttgttattgagggcaacagggcaagctagcttaggaagaaaaagtttggcctaggtgtaagatgtagttgtctaatattgaacagcacagattttagaacattagcatcaccacagaaaattcgattgaacagcactgtactagaggtacaggaaagtgagagggtagggtcttacagaaaatgttggagcagaagaaactatgccaaatgaggatgtgagcaaggatattctgtatttttgacaattttgaagcattatttattattttaacgtttctgaaatttggatgagtcatgcaattgatgtgctcatttaataaggttagtgtttatttttgtcctgaaaaaccattaagcaattaataatgcatctcacaatcagtgtcatcataatatcaatgaaatatggtaagagcaaggccaaaggaagggttttcttactgggtggtgatcacaacgataaagaatcaggacaaaaagactgaagagatgtggtgataatgggatatgagctgagttggaaaagaactagccccaagatattagtcagcactttggaggggtgatgaatttgccatggtttaaagtacttctttgagtttacagcacccgactctgtgttctcagaccttatgttgtttgagaattgggctgatggtgagtgtcaggagaatgatgtcagtcattctaaaatagtctcccaggtgctgatgcgctttggcaactacagtaggtcttccttaagattgggcatggaagagacaaatgtcggagaaaaatacccctcttgttttgagtggagaaaatcagaagaaagggagagagatcggggtgtgccgaaagcaaagccaatgtgatcatcaagataataatagccatacattaaggtagtcaagatcatagacttgagatctgaacttggatggagatgatgaactacacagttttagtctcatcaaaaagtcagctacatcagatggaactgaagttgtttgttttgttttactttttgatgctgtaataactctggcatgacttttcacagcaaattagaattaagaccttttaaatttgtcccaaatggttattgatacctgcaataatacttttccccctggaattatattttcctcttaaaatatatgtgtgtatgcatacattcgtatatatagtgtgtgggtatgtgtttgtgtgcatatgtgtgtgcatatatatatataaagaaaatagtgtagcggaaagaactctgttttctaagtcaaaatatctgattttgaacttggggtccagtgagccacttaatttcaggtttaacttctggcaagttttatcttctgaagccagaagtcattttcttttaaaaagaggcaatacttgtaactcttttaaagatcagatgacataaaagatatgaaaatataaactataacgtataaatatactgaactgtaaagtcatacaaatttaagtcattaatgttactgattggagttcatttctcagatttcacatagttgttgggcacagaaaatttggaaactttggctttcattcttgcacagactaatttagcatcatattcttgttctttgctgatttatcaggtaaggaaaaagtcaagtaaaatgatttggatgcctcactgccagggaatgcttgataaattaaaagcctggcttcctagggacattctgactactgttgtttataaccaagatcttttgcaaccttagacttcccaggaaaagcctgggctttgttgctgcaggaaggagaacagggaggaaaatatctttcagatttaatcagtgagaaactactaggaattagccactatgctagggaatacccaatcattattttgatacttttgtaagctgaagcatcatttaggggcctagcaggtttgctttctgatcatattcaaagccttcacctgggtgaactcctgtgagaacctataattcagggatgctaaagtcaccatggtgacaagaagaactcagctggcttcctattcaatgcatctcagatgaaggtgctcactccaggaaacataaaggatatccattaatttttagctttttttgtgtgaagcaaagggtattgctaatatacaacctctggaatagacctgatcagttacccagtctctggaagagggtggtaattgaaaaactaataagggcaggccctagtctaagaaactaaatctaagacagccacctgaagtgtgaagatggaaattgcagagttgagtctggagtgttttataggcttatagctctaacttgcctaattgaacttttacaattgaacttttacaaagaaagtggggatttatttatactcctactctagggggccacaaaaaaaaaagaggaaatgagagtataggagatttctctaggttatcataagaaagaagtctgacaatacaatccttgttccatttatctttttataataaaccacaaaatatttaagagctgttggaattctttgtttcttccccatgctggctattttgccattctcttcatctcaatactttgctgagtaaaagtcttgaaaccaaaaatatccctacaattcatgaccttgagtgacttcaaaattcagttagacaaaacagacagctgagttctgtggttctcaatctttgtacttttaaaagtattcatgctttggttctacccacaaagatcctgatttcactggggctgaagtgttgaaagattttatagccaccaaatcaccctaatgtgcaatcaagggtgagaaccttattttctcatatcccccttccttatatccactgatcttgacttcagttttaccttggcaattcacctccatggccacactctgaactttgtcatcagccagaactgctccaaccaacctcaaaatcttaaactcaaatatcccacactctaagcatagttttctttctttctagctcctcttattacgttaaagacctaatagtcttatttctcaactgctttcttgctaacccttcattgttctcctcataaacccaaacaggagataacaagccaggattaatccacctgtgtgatctccccatttttaacccttgtgtttccagagaaaaacacaaccacttacactggtgccacagcaagttcatactctccagacccaattggatggagcctcaatactgccaaaatcccattcatttctctagtcagccttgtgtccttttttcccaataaaaactctgtctcttggtcacatggacatttccatcctatttctgtttgaggtagaaatctgctcctgtaccttgagtcccacctgcttctgccttttcagttgacttgctccttcacctgccacttgtcttggatcaccagctttagccatggactaagtctttaacatgggtatttaaacatacttaaaacacttccttcaaaaagcaaagcataacagtgctaaagcaaattttcatgggtcctcctctgcctactgccttcctccctctaacagccaaataattttgcatctactctcaattttgcactttcctacaccaaatatactgacatttttagtgctaaatccaggaaattttttcttagtctttgttttactcagattctcttcagtatttgaagagtgtaggccactctctgtgcataaaacagtctattcctccatgggctcctagctaacagcctgcagtttgtcagttttctttggggtttcttgatcctctgcctaccactgaaatggcagtgttctttcgtcagcactttctgctgttaccccatattccagaggtatttagccatggctatgcatcagaatcacctgcaaagccttttaaaatgcagccatccgcttgctatgctcgatcatctgaatcagaattactagggattggggcccaggcacctaagttattcagaaattccacagatgattgtgatatgctggtggtcttcttcacatccatgccttctcaggcattccctttatcagtctttcatctggatatcctagaccctaggcttatattttagatatgtctgcacaagatgtccaaactcactgatgtgtccaagagagcctccttgcctccattcccttcccatctcatccaatctgctctaccacctcccccttttctcctcccccatatttcagtctgaatgagtgacatcagattttattaaattgtacaagccagaaacttgataatcattttgaattgttttatttatccctcatgtccaatcaattgtcaagtcatatcagtttcacctctagtattctccaaagttttttatatacatgggtattactttaggttaagctaagtcagtctgtgttgctataacaaaatacctaaaactgggtaatttataatgaacagaaactcatttcttacagtctggaagctggaaagtccaatatcaacgtgccagcatcttgcgagggctttcttgttgtgacatcatatggcggaaagtgagagggcaggagagagcaagaagggactgaacttgcccttataagggcaccaatgcctcccatgagggtggagccctcatgacctaattacctcttaaaggtcccacctcttaatactgttacaatgactattaaatttcaatatgagttttggaaggggagaaacattcaaaccatagcagccaccatcatctgtcttctgaaatattaccaccacctcctgactgtatcctctgtgtttggctttgcttactcccactaatctgtttttcacacaatgctcagaacatttttttctagaggataaatatgataatatatatttcctgcttaagacttttcagtgactatctgttgctttcagaatagaggccaagctgtaacatggcatatatggcccatcagaacccgacgcctgttctgttcttttgtcaggtcctctctttcattctgcacacagttttcatcacaattctctggcgttcatgattctctcttgtctctgagcctttgtttctttgctgtttttgcctagaacaccctcttcctcttggctcaggtcttacatcttccattcctgtcaaggtaactcctcctcatgttccagctcatatctgatatatcatcttttaaaaggatgtctgcctaaacctgtagaatgggcttaagagggcttcctgtttattctcatactgtgtacaatgaaaatctactcattgatttacttctctctcccacccaactttatgttcctttaacatagaaacttttaggcatcgaagaattcttttttttacatgacacataaactctcaatgattgttgaaggaatgaaatgaggagtattcagaactgttagtaaaaaaaaaaatcagaaaataatgatcaagagaggctttataaagggaaagtcagtagttgaaaagctagaagtagaatgagctgactgacttgaaaagaggccactacttagtgaaaagcacttcattggtatggtaggagttgaagtcagaatgcagaaaattgaggaatgagtggtgtatgagttttctgctgaaacaaagtactagaaacagagtggtttaaacagaaatgtgttgtctcacagttatggaggtgagaattctacgatcgaggtgttggcagggccatgctccctgtaaaggagctagggaaggaactgttccagttctctcttgtagcttctggtagttcctttgcttgtagcagcatccatccagtcttcacatagtgttccttctgtgtacgtgtttgtctcttcacatggtgttctttttataaaggcgtgaggcacactggattagggacctactctcttgcaatatgtcctcatcttcacttaatgaatcatacctgcaacaatcctatttccagtaaggtcacattctcacgtacgaggagttaggacttcaacacatgatttctgggggagacgcaataaagtgttggacttgggtttattcgtggtgctattattgtcatacattcatagatcaatattagcttttaatctcttattttagagtccacattgtagcataatatttactgtggttgccatggaagagaagttagtaaatgactttcactatacagggctaccacactggtttccaaattgagctcttcaaggttgaagatggaggacgatggagctcctccaccacagcaccctctctttgcctaatttacccataagcaaagcaaggtttgaaatccacctatctaaaataagacttttagacatgttggaggatatatttttagtcataatgttgatagcaaataagaagagaagatacaccctcagcaattggagacaagaaaatctgatgcataatttaaaagaagaaaacgacaaaaagtacgaaatcttatgtgcacttattacctaatactttaaaatcttggagatatatatatatatatatatatatatatgtaattattaggtctaagtaatacacaaagttaaacccttcactatcttagttggaatacgtatagaggtatagatatatatagatatcctttcccacacttattttagctcttgaaatgcatagaataggaaaaaaatcagaattataatctccatgggagcaactttataccaaaaaacacagaagcaattatatttgaaacctgctagagtacaaaattctagattatctttagcagtttacttttattttcatggataaaatttgaaaagacaagggccagtgactcattctaccatttgagagcatcgctagggagcatgacattatcacagagacagatatatggtgacttggaaattttttgtaggtaattcctattcttaaacttaatatgagttgccaatttggaacactgctacattatatttatcacagagttataacttttaatggtttgagggatcatagatctgaccacatcaatatttggctcattttcaaaatagaaagtgctgaaacaccaaaatactgagctgaattctttaaaactttaaagctgaaaaaccactcatgtacataaagtgaaataagaatcaacctagtgtaaatggctgcatttttgaaattccattgtaaatcttaataaaaaatattgttttaaaaagccagcatgtttggaaatgggtgtaatttgcattaaaatcagatgagattatttcttggttttactactaagacacatggacacaggaaggggaacatcacacaccagggcctgttgtggggtgggggaaggggggagggatagcattaggagatatacctagtgttaaatgacgagttaatgggtgcagcacaccaacatggcacatgtatacatatgtaactaacctgcacattgtgcacatgtaccctaaaacttaaagtataattgaaaaaaaaaaagacagattgtggatgcttatggaaaatacgtttactttttctagactcctagaaggccattttgaggacttctgtaataattcactaaatagatagaaaactgcctagacctatacttcgctgtaagatagtcctcttttggtctaaccctcatttctatttagctaactagctagtcaggagtgtaaggtaggcagtataaagaattttaaacttactagggtcacattcaaagtaagcctagagtaaaatcaggagatcagattaccccagctactgagactgaaatgtgaactgtattgttgaagagcttttcttcctcacaattgaagaagacataaagactggtgatataagagcaaatgcagacacttttggtcactgttagcttgttttgaatgtgctgactgtgtctgtgtccatcttgaaaatattgaggagtcagcaaaacatatttgactctttacccactttttcttaaatgtttcatagtcatgagtatttcgtgggggaatttaatctatgtgcctatgattcatttacactagtctcatcaaaatggcatagggagatattgaatggctaagaatccttaaagtttaagaggccatttaaggcttttatctctgaaccagaaagtcatagtgtaccaggactactcccaattcaaacataccagggttcaattttgttttgtctaatatatcccaggaaaccttactgtttgattcatgatttctaacctcaaaatgctggtctaacatatgtatatatatattaatgaagtccaggtaagaagcgcatggctagaatgggaatgttcaacataaaaatatcccagccaggcgtggtggctcatgcctgtaatcccagcagtttgggaggtcgaggcctgcagatcgcttgagctcaagagtttgagaccagcctgagcaacatggcaaaaccctgtctctacaaaaaatacaaaaattagctgggtgtggtagtgcgtgcctgtagtctcagctactcaggaggctgaggcctgagaattgcttgagcctgagaggtggaggttgcagaaccgagactgtgccactgcactcaggtctagatgatagagagagaccctaccaccaaaaaaaaaaaaaaatgaaagccacattttgaataactaaatttgaatatcagcacagttgcctgaggatgtatcaatttacagataaatgccttcctaccaactgaagaataactagtgctttaaaacttttcatccattaaaggaaagtcacactgaattactccgttggtgttgtgcgatattctatagtttttaaaatgctttaaaatacataatcttgtctgattaggtaaacaggattggtattctctccatttctaaaaggggaaaatacaattacatagaagtttgtatattgttgctttatgtgtagtaacatagactcttacagttctgagctatgattgtatgcaataatagaagcaatgctgcacatatctcatatagctctattttatttttaaattcacttttctcatacttgtaagaaatctttgactttggttttagttaaaagataaaacaaaatcataatttctatgataatacaaagcttgaatattatcattggcataaaattcagttctaatttttctccaaaataagatgcttactccaatataattatcttccttcttaattttacatatttgcattttaaagtggcctattcctatggggctaatgtcagagcagagtgttctttgaactcaatgtgtgctccccagtcaggtcaagtccagtcagggcagtgactaagaaatgggtcagaacttacttaaattatgcagttgcctggaaaaaagttcaacttatataatatatgggaatatgtgaatggagaatggcttcccccttaatgtgtaaactgtaactcaaaatatttttttgagttatagaaaaatttttttgtaaaaaaattaagaaaaaagttttttttaaaaattgagccaaatattaagataatcttcatggtgaagcattactaaattaatttaacggcagtcttaatgtaatgtaattttggtttactgatatgtaatcagttaatcttgaagatttcataagttctggcatttgttctttcctcttgtttctctcttataaattggtcaattctccaaaatatgcaaattaaatttaatgttaacctatgtgtaagtcaaggcatgtgaatcccatgaccaaataaatattacaaagcaggtgtctctacactgatgctgaatacctaccatttagagaagacaactctcttccccagggtctcaaggcatctcattcccctggctttcccccttttcccttgaggactctgcatcctcctttgctgcatcctcctcagctttccaaagtcttagcatggacatgtcccaagcttagtccttgcagtcttctgtcctccttctgcgtatctcttacacctcatctaatcacaagacttcaaagtctatatgccattgtttgtcaagtctctaccgatctggatctctcacctgatacagactttcatattcaactgccttcctgtcatttccaccatgatgtctcctctatacctgaaactgagcatgtccaaaaccaaagtattgctctttcccagcaaacttgctcctcctggagccttcctgatctcagaccaaactttgttgttgtctttgactctttttttcctcacactcccaattccaatccaatcagcaaatccagccagcattctttcaaaatataacccagaatttgcccatttctcaccatcaccatggcaaccagcttggttccggccaccaactttcccacctgtgttgctgcaccacctcctgaccagtgtccctgcttcagcctgttttgcacccctcagcagagtgaggctgctccagtctaggtggcattaggtcacttctttgctcagaatacttcagtaacttctgattttcctcaaaatgaaattgaaggtctttataataatctactattttttcctgtggcctctcagattcagctcctactcctcctcctctggtccagtcactctggtctccttccattcccacaactatccaagcaaagtcctgcttcaggtacttcatgttctcaagtccttcagccagaacttgcatcagcctgatatgccattgttttctttcctcacctctttccatcctttatttggatatcttcagagtgaggctatccttttattttgtttttaataattatatcttcaccatgcctgttcctggcattccccatcccctcttctttttaaattgttctccctgcaaactgttatcatataatccttatatagatttcactttttctttttgtttatttttcatctctcctaccacgactcaagagccctagttatttcatagttcactgctatatccctggcctttagagttgttcttagcatatggtggcagtcaataaaaatttgttgaatagataaataattactgtctatcttcctctccttaggtagaagcaggctatataaaatataaattattggattgtcagacttgcccatatttatattcaaatacgataatccaacttggttgttggaatctgtaaaaaaaaaaattagaacatccatttttaaaagattgaacaagcagtaatttttttccaaatctaaaacaaacaaacaaacaaaaaaaacagtgtcaatcaaggaatcagaatatatattgaattaattgtttttaggtcattagtgaacttgactgtgctgttgctctcaaagcactaaaaatagctgatatcaaaccaaaggtccttcatgatccttgaaacttccttgcagttctaaagaaaaactcaagcttataggaagaagttttaatgagacattgtgctgttcaggagagacaaaatcatagtttctgacctcaggggcattgataaaataagagagcagaagctctagggaaattagtttttaggaagtggaatccggtggctcattgcacattctaaatagcatcagagtaagaatgacagtctggctgattggctttagtgatgtggatagatttggctgctatattatcaaaactggattgaaatccctcaatatcaatgaagttttacaaaggtataaggactactgggccacagttcattctaggacttcatttaagtgacaaagtaaggtgggccaaagtgagattgggacaataagctaagtaatcttaaatttgttcttgtgtctatcctgatttgatcaatccacaaatattaatatttatggaacatttactgtgtaccaggcactgtgctagggagattgtgtaacagtgaccacagcagatgtaaaccctgcccttaagaagtttgtatcctagtgtggagacgggcattcagacagataaatgaatatacaagtgcaggttgtgatgagtgttacaaggggaaatacaagggtgctaggggagagaacatgagccatatgggttaaaccagggctatcatctgactgcttgtgtcctcccaaaattcttgttttgaaatcctcacccccaatatcatggtattaggaagtggggctttgggaggtcattaagtcatgagggcagggttcttacaaatgggattagtgcccttatgaaagaagcctagatccttttccccttgagccttgtgagcttgcagtgaatagatagttgtccatcaacaaggaagtaaaccatcaccagatatccaatctgctgatgccttcatcttggacttcttagcttctaggactgtcagcaataaatttctgctatttctaatctactcaggtattttgttatagcagcctgaatggactaagacaaccaggttgtcattaaaatctaccctgaaggttcagtacgaatccatgatgtatttgaataagatttgtatgtgaatcctctgtaaggacatccagatttgtggtctagatcccatttcttcccactttctaagagaccttgtacccctagcccctgtttctttctgccagcattttctgtttttctccactgactccttaccttctgccattatcaagttttacctattttgaaatataaatatcacatttaattattctccatagccttacagacttcatgtcttcaccactcaaaacctcatgtagtctccttttccccctcgtttacttattgtttcattgaggtgtatttcaatgggtttgaggcatgatcccatccaaaggactaatgtgcatatactcaaaatgttaattcagctgaactgctcacatctttgcttcattgcccatgtctttttgcactgaattgtaagccactaagctttgaatcaatgaacattttaaaatgttatttgtatagtgtctaaaaacatgtggcagttgagaatagattaatctgttctagaccaaaataagatcctggtgaagaggattttaaattcttgagttgaaagctgatcaaggtggaaccatataatgccacatgatacagtgtgatgtcagatagattattgtaacaaacacataattaattagtaatgaagtaatagggttttagatgtttaatcttcaagctggtagatataaattaggtcacattaaaatcagttctccagtctcaatagctctatgctcatattctccagcataaacctcagtaactcacacaacctctttcacttagcatctctgagactctggggggtgccttgcaattgcccctgcatggatctgcccaggatgtcactttgtactggtctctgctctaccagtgaccttgacccatgttcattagtctcttgattgcctaacggcagacaccaaccagtttgttccagctatgaatgttctctgttgtatctagggcagtaccagaacactattcacctgcagagtagaaaggagagtacatctcccttcttgctctctcaggggaagccaacagctgtgctgcttctggagctctcaaattctaggaatctagtgaaaaaagttctttcagttctccacacaactctttgtatttccgggatatgattaggagagttcatatgccagtcaccacaatctgccaagaaccactacacctttcaggaagctcagagtttgtggctgaggttcgggttattcataccagattccttttttctgtagagtgaattcttagtcagagacccattttctgttttagtgagaatgggctacaggaacaacaccaaaagctcagttgcttagaagagtagaggcttatttctcactcaagctacatgttcatgacaggtttgtggtggagggagagggttctgctcttcacttaggaacacagttaatgggagacaccacagtcgggaaagttcccagtcattgtggcagaagacagggcacttcatacacagacctcagtggtttcccccagaagtgacacgtattgcttctgctcacatatcttttttcttttttgtcttgtttcatcaaatcatagtgatattcagattaactacatatatatatgtgtgtgtgtgtgtgtgtgtgtacatatacaaattagagagatatacgtgtttctcatgctgctcacattttatttgccaaagtaaggttaccatgcctaacttcaaaggggcaagaaagtgcaatcttgccatgtgccttaaagagggagaactgagaatggtgacgaatagcaccaatgatgagtacaccttcttccttgaagttttgcatctatatccttctacttcccatccaatcctgccttttatgacatatctctctacatatgatcttcaatcatgtaaattgctcagtatttctctatattaattagtggttctggctaagggtctctcacgagttgttggcttgggctacagtcatctcaaggctcagctgcttcctcagtgactcatatagttgttggaaagcctcaactccttgccatgtgggcctctctatagggctaaccacagtattatagcttgtatcccccagagtgagagatgagagagacagataggcagacagagacggagacaaaagacagagacatcccaagacagaagtcaaacacagtctttcataatctcttcttgaaagtgacatgtcatcactgctgtctgataaccaatcctgggatagagtgggagggggactctacaaagatgtatgttaaatgccaggaggtgggagacttcatggaagctggctgccactctcattcaagaaggctacttactcttatgtaaatcttggctgccaaaaattgctgtctaaatcatagcttcttccaagtagcatacccaggacagggtaaatgcaatttaaaacttctctcaagggggttacttcatttagactagtgttggtgttctcctatgcaattaaatggttcttgtgtcttatcattttcaatgtccaatatccaaggaaatacatgcactcatccacagaatattttctttatttttaaagttttaatgctgtttttaagtcccttgtgtttaggtggttgttatacttgaaatgttagcagacataatacacagcaaataaattcttgatggttttgcttatcctcttctctagaagcatgcgctgtgtgagctaagtgtgactttaaataggacatagggaggaattagaaatagaggcaaagtggcagaaaccccacattaaaatccatccttgtcagcactctctgatttcacataccagggttcttttcggattaatcaaaaaattgttgaaacgtgttaaaggagaaatgcaattctgtaaggggaacacagttcctatttggagggaaggaatatgtatggccactataataacaaattaggggaaggcatgtgtgaatttttatgcactcatcgtcctattgagcacaagtagagaggtttattttcttttcttcattaattgttcttacagaaataaaccacactgtgtaggaaactaggcactcttccctacctactcctgctattgaaagagccttatctatggaaatcctcaaatcagcttcttcttattgtaccagtgatgtctcttggattaattcagacaaactgtgcagtgtaaccaatgcagacagtatgttagaagcgcatggatagcttgcttccttttcattccttcttccttcctttattgtttccgcattgtggttccttgtatcctaccatcttgaatctcttgtacctctaattatagtatgctcactatatgcaaggtttctcctcccacctaccccctgctgcctcctctactgacatctcacttcattcccaagaaaaacattgccctcccctccaagctcactgtgtttgcatttctctgctcttttccgctctcctccttggcatgctggtttaatcaattttaccaaatgactttcctggcagctgtaaaaagaaaaccccagagcaagttaatagcaatctaatactgcactttctgtcatttctctaaaacgtacagaactatttggtcattggattgatttttaatgatctaaatgatcagatgtttcaacgctgcactgcagcagcctgataataaataggaaaggggaggggcatggatgctgggcactcagtcagtgctagatgaataatcctaaaacagcagccaaggagacaagataaaatgtcagcctttgccaaatcatatattagcatttttaaacaaagacacctctttattttgattttgcatatggggaactaaaacaaaatgtttttgatgagggtttaggaagtcatcaatagggttaggaatcaaattacagcctaattctacgcgtatctgttgacataagcagaacgtcagtaaagtgcctcccaatatctctaaatagcctcttggcatctgaaacgtagggaaaaatattggttactttttaaccaaaaggcactaaaacttccaaaggtatatgaaatcagtaaattataaaacatgtccccttcccccccttctgtaagaaagaaatagaaaacaaaaagagagatgaatatggggaaaataaacaatgaaataatattatgaattaattgtaagacttgctaactggctgtgtaactttgggtgatttgcttaactattctgtgctttgttttcctcactgtaaagtggacaaactagtagtacttttgtggaagattaaatgaggaaaggcaagtcaagtattgagcacagtgcctggcatttactacttacgaaggttatgttctttattactccatctactctttccataattgcatcccctccaaccagtcctgtccagccttctccgaatccacaggacaattctggtctcccagtatggtgggcaaaggtaggttttggtgtccaagcacagctcagccatttactctccaggtccatgggcaagtaacttaacctctccaggttcctcagattcatcatctataaactggggaatattagtacatgctttataaggttattgtattaaaggaaataacttgtctaagtctcaatgcacaaagtcttccccagaagacagacttgaaaaaatattaactttatttcactctcctcctgctgccatttccaatgtgctgttgcatgtttctaaatggtatgtggaagaaagctgattagtttctttgctaattattaattgaattcctttagttaatacaatgtattcttttgagaagctcagctcaatttatagtgctagaaacatacaaatacagaatttatacgagttgatctggggttcacatagatgaaagggtgttttcctagcacattgctctgagaatactgtaacactcttacttcatgtatattcatgtatatacatatgtatatatctatatatgtctgcatctacatatgaatatatgtatatcaactgttcttatttagtatagttctccctgaaaaagaaggtactattttatttttaaatattggatcttatttttaatattggatctatctgtaataaagtagccaagttaggctgactacctgtctaatgagtttcccgtttagatggattagttccatttagtctgttccatagcccagatcagacagttcactaacaaatacacttaaattcacatcactttggtccagagggtgtaactaaggcccaaacctgcttctggtgaaagtgacccagaggtacgctttgctgataatatcaggagcatggtctttgtaattggaagacactgtctcccatctccccatttgttattgcaagaaaattagattctcattgaaataacaggcccaagaattatagtaacaggagtttgaacccctgtttgagaatgttggtactcctgggataaatgagatcaattttagcctataataacggtgctttctacactttttagatgttagagaaagtctggcagcaaagcaaagctttgtatataccatgggaggcagggttggagaataaaagaagaaagagagacttaagaacaaaattgtgtttgatgggatgttttgattttctttaaatactttaagtctctagaaataacaaatttattatctgaaatacaaataagaaatacttatatttggaaagttgataaaactcaattattgtgtaaaatgttcacaaatttccaatggatagaaaaaaataaacttttgcattgccaattattgaatacttattttcacctttggaaatagcaagtcagttacaaattttataaatctatataattgtctttatacataataaaaatattctgatgttttgtcagccaatatgcagttttaagcaccttcaaccctgttacatgtttacgggtttggaagttactggggaggaggtagaaaggtctgaccttctccccaggaatttaatatctggtcagagagaaagaaacagacttttgttgttgttttgttggtcttataaacagtgccaaaatgaatgtgtgtatgtgtgtgtatgtttgtgtgcacttgagcaatcatttttgtaggataaactcttacaaatgtaattgttctgaaatggtatgtatggtttacatttttaaaaatttgctaaattgtactccaaaatgtctctcctaatccatgtttctaacaactgtgtatgggtgtactgtttcccaccccctcacaatctgcatatttttagtcttttaaaaaaaatcttaaacgaatgtgataggcaaaatacctcattgtagtttgatttatttttggttatcagtgagattgaagatcttttcaaatggcttttgactatttatagttccccttctgtgatggttatttgcatccatgtcccatttttcttctgggttattggtcttactctaatttatagactctccttaaggcaaatgataccaaaaccataccatggctgtttacagtcgaccctcccagcttacgttgcattaataattgcttcttagaagcttatgttattcatccttctcctatttctacactgctgttttcttgcttccctaatttaacattctcaccattgcagtcagcaggttaaatggcaaacatctgaggaatcaagggaaacaactatgcattgagtacttgcatgtgctacatgatttaatctataccttctaatgtaatcctgaagaaatctaggagatatgtatcattgttttccagacgaaaaaattaagatttggttaaggttgggaaatgagactaagtaaataaagtggtaataagagactcaggtctgtccgatgatactaaaagcctgtgctccttccagaaaaccacgctttcttcagaaaaactgtttttacaagactgtattcaaacatatggcatgtcttgatatacatctaagtaaattttaaaattatatctatattcttaactgtccaataaaattgtgtatttatcatttacaacatgatgttttgaagtatatatacattgtagactgactaaatctagaaaattaacatgcattaactcacatggttatttttgtgatgaaaacacttaatatccactctgttaacatttttcaagaatacaacatattgttattgactagaatcaccatattgtacaatagatttcttgaacttatttttcttatctaactgaaattttgtttcctttgatcaatatcacacttgcacctccatttccagttgccccagcccctggtaattaccattctaatctctagttctatgagctcaactgttttaaatttcccatatgaatgagatcatgcaggatttatctggatatatacctagtagtgggattgctggatcatatggtagttctatttttaattattcaaagaacctccatactattttttataatggctgtactaatttacattcccatcaacagtgtacaagggttctcttttctccacattcttgccaacacttaatatcttttgactttctgataatagccattctaacaagtatgaagtgatagctcattgtagtattagtatgcatttttctgatgattagtgatgtggaatagtttttcatatgtctgttggccatttgtaagtcttttgaaaaatgtctttttagttcctttgcccatttttcaataaggttattttcttgccattgagttgtttgagtttcttatatttttggatacaaattccttattagaggtatagcttgtaaatattttctcctaatctgtaggctgtctcttcactcagttgattatttcctttgttgtgcagaagctttttagcttgatgcaatcttgtctattttggcttttgttgcctttggttttggagtcatgttcaaaaaatcattgcctaaatcagtgtcatatagcttttcccctattcttacatttatgtctttcatccactataggttgatttttatatatggtatgagataaaggtttatatttattcttctgcatgtggatatacagttttcccagcaccatttattgaagagattgtgtttccccaatgtatgttcttggcacctttgttgaaaataagttcactgtagatgtaggggtttatttctggctctctattatgtttcattggtctatatgtctgtttttatgtaagtacgatgctgttttggttactacaactttgttgtgtattttgaagtcaggtaatgtgatgcctttggcattgttctttttgctcaaggttgagttggatatttaatgtcttttgtggttccatatgaaatttagtattgtttttttctgtttctgtgaagaatggtattggaattttgatagggcttataatgaatctgtagattgttttgtagattgtttcagatatggacattttaatattaattcctccaatctatgaacacgaactatctttgcattcatttgtgtcatctttaatgttatacagctttgtaactattataaatgggattttaaaaatttctttttcagatagttcgctgctagtgtatatcaacactactgatttttgtatgttgattttgtatactgcaatttctattataatgaatagaagtggcaagagtggccatcttttcttgctctggatcttaaaggaaaagctttcaacttttccttgttaagtatggtgttaactatgtgtttgtcatatatggcctttgcttgttgaagtacattccttctatacttaatttgttgaggggtttttattatgaaaggatgttcaattttgtcaagtgctttttctgcgtctattgaaatgatgatatagttttcgtcctttgttctgttaatgtgatatattacatgtattgatttgtgtgtgttgagccatccttgcatccctaggatgaatcccacttgatcatggtgaacagtctttttattgtgtttttaaattcagttggctagtttgttgaggatttttgcatctatattcatcagaaactttggcctgtagttttctttttttgtagtgtccttctctggctttggtatcagggcaatgctagattcgtaaaatgagtttggaagtattccaccccatcaagtttttgaaagagtttgaggaaaattgatattagttattcttttagaaaaatttctattaacctagcagtacaagttagctagtttacacttggggctctgaggagatgtaatggagaaagagctgaaattggggttcagatttataaatctcaagttttggttgagcacgaaaggagagggagtgagactaatgataagaaggttaaagtaatcactggattgatttgggatgggcagtctcaaaagtgctgaggattcagttcctatttcagtgagctggaacacacaaacatagaggaaaaagaaagacagttcaagtataaatttgaatatacctaaatgtgtgtaaattacggaagaaacaacttcaaaagaaaataacaacaatgacatgggctacagaacagttaagattaatgatccctcattatagggtgccattcagacataggagttaaaaaaaaaaaaagcaaaccagaaccacacactgcagcagctccccagttgcaagcacactgaaataacagaggcctgccttcacgggaagaggattagttctactgtgacctgtttatataaaaacaatgttgtgggtagcaagattactagaaatgacttcttggattataaaggacaattatgatagcttaggccactagctttcagtacattccatctggtacgttacaaattagctcattattctgctgttcttacgaatgtgttagtctgcaaacatatcattgtcacaaattagtcacctagtgtttctctgaaagtgatttaatataagcacacccacatcataggatggaacagtaaaatgggtccttgctagatcctccaaacagaattcagcataaagcacaattcaatttccaaaggtttttggcacatacatcatcttctgattttctaagatgaaatgtgattgttgccctggatattggtaatacattgtaatattagaaacctcttgggtctccccatgaactctagagatccaagcctactgagaaatgatgggtccacaaattgagcatagcttttatttgtttttatttacatttgttatcgcaggtgctatcacaactgttgtttcaataatagcaatttcaatttgaaaattaacttaaagatcttattttgaagtgtgttttgtagcagatgagctcacccaccagctacttggaaagaagaagaaaagtgaggaaacataaacttcctctgctgtctaactggattacctactgagacatccccttgtgtgggttataataaatatttatggtaaacttcttaagttaagatgcctttggttgcaagtctggagcccccaacttaatggcttaacaaaaacaaatgaggaaaatgtactgtcttataacatgaattttcaaggtaggctattccagggtaggttattaagaggttcaaacacatcacccaggttctgctttgccatcttagcactttgtccttttgctcagacttactctcctcatttacacaggatggacagtcatagccagacaccaggaccaaaggcagaaaatgcaccctttcatgcctgagcaagaacttgtgaagatatatttttaagagagagagaactgagtagtgccgtgagtccaaccctaccctctcttaaagcgggctgcagttatctaactcacattaagctcaaagagagacctggccttcagccatttgatgtccttcccaagaggaccatctgggaaagccagtttggctccaagagcaagagttggtagggatggaaccactagaaaaccaaggccttgatgggggtgctggttaatcagcagcaattggaaaacaaggctcttgcttgagtcaaaggagttgcagccagaggacccagcagggataccaattatgaacccacaaaagtaccatgagacaaagaggcagctttcaacatctgccaggtctccaacatgtgatgccatcttacgatggcactaattcaggaaaacaaaacaaaactcttttcttcctttcctcaccactttctgtgccttccaatcccagaggagtcaataccaacggctagccagcctggatagccaaggaaggggaagagcaacccagtctcaatgccacccacttactccactgcacacagagactctgtggtgggcccagctgggagaggggagaaaatgtaagttcaatcaagtttagagttttgggttacaatttgaaatggacattctaatttctggatagagtctgagatgatggtttagcatgaatgcaaaggtctctattgcctaacagtacccagaaaagtcataagatgttctttataaataaagtttaaagggacagtttgaaagcaaataaaatgtgttttacactttgggagaccaaggtgggcggatcacctgaggtcaggagttcaagaccagcctagccaacatggtgaaactccatctctactaaaaataaaaaaaaaataaataaataaataaaaatagctgggtgtggtggtggtgcctgtaatcccagctctttgggaggctaaggtagcagaatcactcaaacctgggaggcagaggttgcagtgagccaagattgcgccattgcactccagcctgggcaacaagagctcaaaaaaaaaaaaagaaaaagcaaaaaacagcattttgctatctactacatgtcctcattttcagcaaatatgttacaatattgatatccatttacaaatatttttaactaccttgacaataccatatcatatttgtatctttcttgcgtgcttcccctttcttactctaatatttgaggggaaaattatttatgcctcctagcaaatatgcttctgatctttaaaacacctctgctccagcaaatggatcccaaaagagatgtgcattcaaggtgtggaaaacagcaggtcactggggggaatgggaaagttaggatttttattttttatattgctagagacagggtttcattttgtcacccactgcagccttgaactcctgggctcaaaggatcctcttgcctcagccttgcaaagcaccgggattacatgtgtgagccactgcactggctgaaaattagtattaatagtaatgtccttctgtcctagtccactgtttcactttcctttttcttcacggcttcctcctttagactcccttggactgggagtttagcactatcacctgcacactagacctgcagtctatgaagagaggctgtcagggatttggggctatcacagttgctcctcccagagcaaaaaatattcaaccctcccacacacacaggcagcagcctcatctcaaatggactgtgcctctaatcagtgagtggttatggaagacgaggagaaaagtgcatttatattttcattaactttgttcctgcttcctgtagcattttcattttgaaaatgagttgggaatttcaaacatcaataaaacgtgctgaggattctgacaacaaaatccttttttgtcatgtgctatgttgcccacttcctgctttttatttttgctccagtccctgtttgattgctaatctaaagggaaagggagggtcagtgagaaaagaggagaaatcttaaaaatgaatttactatttgatcaggtttgctactttattttgtggaaaattttaaagctcttttgtgtctttatgtattttacaaatcttggaactaaaaacaacagataaaatcacattatattccccattgaattatttcccacatttcaaatgtgcttcccagagagaaaagtataagatacagagctaggcaattcagtttcacattaatagttttgtgtctcatcagtttgggacgtgtattgttcatgttttgctttgttgtgcctattaagtgatttatatagtctattgcgatttttttaggaatggaatatgccaattatagagagaggtaggcgagttaaaagtttcaagtgctcagcattatagattcaccctcgagtcagaatgttaaaaacagcaaggaagagtgtgtaaaatgctaggtgaatgagagggcatctgtccacaatgggcaactagtatttaataactagccttgaatttattctacacttgaatgcaaagattattctacttaattatactacagtgactttgaaactattaattattctaaattattgggttctagtttaaatacatttttatatttttaagctttcaaatgattatttgaaaaaatttatctgaatatcctttttttcctaaaaaggaattctgccttttgagtactaaattattctctctataaatctaaaaatatcacagtatttcttttttttccaaaatctctctctctctctctttctctctctctcacctctccttatctgaaacaaactgacatttaatgaagaaaactgtgaaaaggggttcgagaaaatgagaagctagtattttgattggaagtgtaatagatgtcagtcagagaaaaagaacagtctccagaacatctagatgtggatgtagatgtagatacattgttaacgccactctgtgcattttaatttaagccacttgatcatgtaaccattaattcaatgtcaagttcattcattgtagctattcaatattacaatatagcattaattttaaatgactttatttcaggagggaaggaaataatttatgaatagcaacataaggtttcttatatgatgactcatcacaatgttgattgcaaaaaaagaagctgactcagactagctcctgtagaaaagggggaacatagttactatgaagatacagaaattaacagaaacaagtatagcagggcctattggattaggaaaactgaaattaaggcagctactctctttggggccatacaatcaccgatttctttttgtctctgtgtttctgttctttcctgccttctccctgtaattgccactgtctctttagttatcagtttgcactgaacccaaaatggtaacttcagcccctgagtctacaggacattttggttcaaccccaccttgaactgattagagtctcaatttcacttaggacatttcacattccaaagagcaaatattaatatttgctgcctagtaaatgaatcagatgtcagtgagtcaagttatcatgcttattcccatcagattttataatggtgaagtgtaggaaaggcaaggtctttagaaggaaacataggcagacataagtaatcatgtttggtatagagactcatttattaaatatttatgataataaaatacttaacaaagtcaatgtcaagataataaggactctgagtccttattatgcaccagatactattctaggcattagaggatataccaaggacaaaacagaccagaaaaccccactacccctagagcatgtaccccactacatgctgatgataatctttagtcatctatttcaaaaataacttaaaaatggagtggcaatgtctctgcgtagtcaattcaagatgccgaaataaaaatacatgtatatgtgtcttccttgtgtgtttctttttttttttgtatttctcgtgttgaacttgcatggttttctaaatgaaatattttcatttttaatgtttcatatatgtgtctgtatatatatatgtaatatacatatgttataaatatatacaaatatatgtatttgtaaataacatagtcatatttgcttttatacctaactctgttaactgccaatgatgtgtaattatatatgtgcatgggttagaagtggtggatggggcctttggattttaaatggcattttacctgcagcctctgatgcagcctcttccagcttcctattaaagtgactgaaaacactgcaaaaatatatatatatataatttttaaaaagcactaaaaaccagtactggcagaatattaaagaagcgttaaattagattgacaatatatatggtggaccacacattgtattccattctaaaagtaggaagaataatttcttagttttacctggaccatacaatacatctactatgtcctactactgtagtagtatatgcagcgatatactacttaagatttttaaaaagaaatatacaagcagacctaaaggtggatcaaaactaaagagttaagaatagaaacatccagaggaataccctcttgagatcatctactggtaaaaattcatcacaagagttttaaagagaataataacttttgtaagccccatctgattgaactgccttccccagtaaacctgtgagagtggagaggtttgagtattttcatggtaatttctttaccatgtgccatctggcaaataaaagagttcttttccaggcagtactttttaccaaattcagaggtcggtgaaatattcttacaacaacataaaaatcggtggtaaacccactattcctggaggggaggaagactggaaagaagtatactgacttgtcttttgggaatggaattatggatgacttgcttctttcttgtgtgtttattttattttatttttgtatttcccatgttgaacttgcatggtttcctaaatgaaataatgtttcctctttaaaaagaaactttaaatgatattgaatctagttaaaatgaaactatgtgataagtttcagattttataaatagattgtcaaaatatgtgttaaacattcttgataaaattacatctttgcttcaagcaattgtaaagaaaatggaatctattgacattacaaatagcaattttagcatccataaatttgaaattgtataaaaattgtacatattctgggtataaaatgttaatgcttgtcatgtaactttgtaaaaactttattttttaaagcatttttaggttcacagcaaaattcacagaaaggtccagagatattccatttactccaacccccacacatgcatagccaccccattatcaatatcccccccacaaaagtggtacatttttttttacaattgaacctacattgatacatcattatctctaaaacatatagcttacattagaatttactcttagtattgtatattctatgggtttgcacaaatttatattgatgtatatcttccatttttgtatcatacggataattccaacatctctggcatgtctagttctgatgcctcttctgtctctttaaactgtgttctttgcctttaactatgcattgtaattttttcttcatagctgggcatgtactggataaaaggaactcctgtaaataggccttaagttatatgggtgggccaggcatggtggctcatgcctggtaatcccagcactttgggaggtggaagcaggtggatcacctgaggtcaggaggttgagaccagcatggccaatgtggtaaaacctcatctctactgaaaacacgaaaattagccagtcatggtgacacatacctctaatcctagctactggggaggctgaggcaggagaattgcttgaacccgggaggcggaagttgcagtgagccaagattgtgccactgcattccagcctgagctacaagaacgaaactctgccaaataaataaataaataaataaataaataaataaataaataaataaaataaaaaagttatgtgggtggtggtgtggtaaggggcagtggaggggaagctttctatcattccataattaggtttcagacttttggtgagcctgggcctctggattgtgaatctcctaagtgtttttcaggttttttttttcttataccataggtgagagagaatggctaacgtgggctggaattgagtatttcctttctccttgatggtaggctagagtgggctggagttgggcatttttctttccccaggtcagtgaggctctaatataacaaaacaaaatggaacaaaaaaccccagcaggttaggctctgattaactagtttctcctcaggaagaaccaagcttcagcagatttaaagatgtgtactttttcccttctcttgctggaagcatgagagaatttttctccaatatttactgtgagaacttggtagcactcctggaggtaaaacacacagaattgtggggacctccctattactgggttcctctggagtttttcaactttcagacttgcctgcactcagcctctaacgatttgtcaattatagttgaggtttttctaccccagcactggttctcttggaggtttctgctccggtatgttgtgattctccatagcctactgtctatctcaccagtggtttgggcagcagtttgccctgtgacctcacttctcttatggatctaagaagagttgatttttcagtttgttcagcttttttgttgttaggacagattggcaacttccaagctccttatgtgaggaactgaaagctggattatgttacttttttactgggaggttgagtgatagaagaactgtcatcagaagtttaattaaattatcaatcagtaacaatcaattaaatttccagtgaaagcaaatctattttggatacatctaatcaggataaatgaaagaataagtgtgcattcttacaacatttctcttttttttttttttttgagagccattacaggtgcgaaccaccatgcccagctgataatatgagtaagttttgaagttgggctttattttattacatgagaaatatttttgctcctttgaattttctaaacaaatattatacaaagcctttagaaaagcttaagatataaatgaaatgtaattccatttcagaaggtagttttgacattacattatttgtattttttcttttttttccattttgattccagtaaattgcaaaacaaatgatctgtattttattatattttactaagcaaattttaaaggtatatgcaaacaacatttaaagagctcttcttattaaaaaattttaaattataataagttaaaattataataatctaagtgtttgtattacttccatgctacggataaggaaattgtgtctcacagaggtttcatgcgttggtcaaaattacacaaaaagtaaaaggcagaacctgaaaataagggttcacatcttaggactccaagatggtatacacatttgacttttttgtctttaaacttgctgtgaacatttttccacttttgattcttaagtataaatattaagtgccttctttgtatttcagtattaggcttttaagtcttctacttccaaaaaaaaaattaaaagtaaaatttaacaagcattctaaatattccaattatgaaatatatttcatattatgagatttttcttctgtaaaagaatttatcatttaagattagaagatttaaccttgaggagtatgatccaaaatggctttttatattagttgaatcatgaaaagtcccaacaaagcatttgctggttttaggtgatgaaactaggtgtttaatgaatttattttttcttttctaattggtgattgtaccctgggttatgagaatatgtagaaattgaatgtagtagctactagcaacttgctgaaacatgatgcatttccctgactctcagcaactgaaactgcggcttcatgaaaggcttctcgtatttcagttataaatgttcagaacagcatgccttcagactttgctagaacttgccaggagtggaaagtcatgactatcaacatcgttattagttaacattgactgagtaccaacaatgtttttggtgttataaatatagagaagaagacactgttctgttcctgggggattggctttctgtaaaggtgagatagagaatttggtcttgaatgttcttttcttgctgggaggtggggttggaagcacagccacctcaggtctcattctgatggcacactcacctctttattagttgatgatatatgcaataaaaagaaaaaaatgtataattacacatacatacacacatgtgaaaactcatgtaaattttattttttattggtaaaaaatatatatttatggggggagcttgaggcaaaaagtcacatcctgcaagatatccaggtgacagtagcttctatatccttgtgtataatgtatttatactgttattaatagtatatagaatgtgctaagaaaagtacatagaagtttttgtatgtgtaaatatatttatatgaacccaatatgtagaatacagggaccaagtgttttgtttttgacatctaagggacaaaagtaatccagcctcttgaaagaatggagactttccaaaaatatctgaactgattattggtattcatataagataaataagtcatcttttaggtctttattctttgatgtctaaatatacaggagttttatttcatcaagttatttaagaggcaaacattgacattagctattgattataccaaaatgcaatgatgacaaaaaaatataccttaacatttgacattaaagttactttctgaaagtgaaactcagggaaaatcaatgaagtaactcatcacaccctctgataagtacaagtgactaaagagtctaggaaatacccaacctcaggaactagggtgtgactttattatactatgcttatactagcataaaggttgaacttaatcattcttttatgctcattgtgaaggaagtgtgtaagttgaaggcattttaagaggatgaaatactgaaactgatattacagagataagaatttgtgtagaaagtattaattctgtatttctactgttacatttttgtaattttttttaaagagccagactttttttgtatgtattatcaaactttgagataaaactagttaaagcagaagagctcttgttgaaacagcacaaagtacctggcttcctagacccagcacaaagtaccttgcccctcagctgacctgatgcaactttgaaaaaccatagggttcccagaaacttagtttgaaaaccttcactcttatgagcataaccctataaccatgagagaaaagggttttattggaaaaggacgtgggacaccggctagttaatacttctggctctgattctggatgcattaagcgatctttcaatgaaaatgttgaaagtattttggtttgctctgagtttgtagtttatcaattaattgagctttttattgaatcagcctcatttaagggtagttaatataagttcacttactcttgtgcttgctgtgggattaaaatttaaaaaaaaacacaaaacaaaacaacaaaccagtctttgctctagtagagctgaggttatgccatagctgcagggacttcactgaggttatgccaatttgtggtgccctgctaataattcgcactcctgtattgataaaaataatggggctgagattagccataaagataatcttttatggttactcctgatatttctttttaatttttttagagacagagtctatgtttcccagcctggtcttgaaatgggctcaagttatcctcctgcatcagccttccaagtagctaggactacaggcatgagcaaccagaactggcttcctgatatttcttaaaagtttcatgaaaggatgattatcttttagtgtaacaaaatagattagcattaccctaacccaacaacattttttcatttttgacaacttgtttttagattacaaacctattagttctgcctaactgttgtttcttgaaggccatacatgtaggaagtattaaatttgtaaagtatcagcctataaattagtagacataactcttaagaccctctttctaatataaatggaataaaatgctggaaatgagttatttctattttctaagcaagcctattcttttatatttgttgccttatgtctgcaaaaatattcaattttggattgtttaataatgtgtagtcttgattctctgaactgtgaaataaattacagttttttctttgctatctttcaagcagaaatttggcttttctgttatttatcatagtttctcagttgtgtttccttttgttctaatttgttagactttattctagacagttgcatgtataaaaataaaaatccaacgaaaattcactttaaaaatattcagctaaaatgtcctcttagtttaagtatatttagtagtttaatggccaaatcatttgtattttatttataaagtgctttgcttatatcattgcccgcaaatggaaatgtagctaacaagtattgaatgttgaactgtgtggtagtggagaaagattcagaggtattcttactatcctatcacccataggtgatggtttgacatatgaacagagtagaataaaatggactaagaaaataatgtcagataaatgatgttcattacaaaggaaaatatatttttacatctttttaaaaaatctttgcatttgctactttctatggagacctactctcttgtataaggactgaatgttagttttaaaataattaaaacccatcattatcatcatcatgatcaaagatcactaaccagagtcaaataatttgaattctcttccagatctactgctcacaagatgcctgataatgaacaaatacaatctttttggcatctccaaaatgggcataataaatgtcttaatctcctcagcataattctgtgatgccaaaataatacatataacaataatattttagaaagtataaaagtataacaaggtggtattattatgattacagaggtgctagaatattgtggtaatgtgtacaggctctggagccagacttccttgattcagatagtgactcactagatatttaacctcagacatgctacttaacatctgagtgcctcaatagcctcatctggagaacagggctagtaacagtccttaactcatagtgctgttgtgtggattaaatggggtaatactgtaactatcttagaatgggacctggggcattgtagatgttcctagctcttaaataataatatttaaatgtctaatataatatcaaaattttaattacttgattcaaaacattcaaagcttgttaaaaacaatgtaggctgaagttttctgggccagattacaaatgaccttatggaagagatttagtccctttagcaaaaaggggtcatgaggacactgcctaggctacaggaaatctcaacaaatattctcaagattcttttatgctgtagtggcatctttctgaacctacaagttcacattgcttttaaggaatcacccagttcttcttcctcctaggaatcctccttttaggatcatcttttgatcaaaatgaaaattctccaaattatggtggtttttaagattagttttctttatactaggttttgaatttatgggacatgccctccacccaatcttgggtaatattttctgcaatgacaggacctcactggggaaatcctaaatgaagataatagcatgttatattaaatgttgccggtattccatttaatatcaagcaattgcgtaaaagcctttttaaatacctaagttaaaagtggtatattaatgttgagtgtacttctactgcaaagtccattctcccactgatttcaaacaaataccatttaagtgccaacctactattacaagagtttactattttattcttgctccaaaatggcatcaacagtgatggggtgcttttgggggattattgaacagaatttttgcaacaaaggagcaagcatgaagaaatgcaaaacatcagtgatagggattgcaacgttttatctcagcattcctcatatctacacaccccctaatcaaacaagcagttttatggcatgcgcaattgcaattgaagtacaactgacttctgcagaaccggcttccataggatttcctgtccaaaaatcaccatgtggtcatctgcagctaaatggttacaaatcatcaagtaaacaaggcttccccaccccggtgctttttttttaaggagtgaaatccaccaaactctatcatttgcaaattatctctggacttcttttatttctttttttttcactgggtaagaaggaaaacgagcaaacaaaaaatcctccctccgtatttgtttaaggcgtaatttccctgtgaggtgttttacaggcttctccttgtttagcttttcttgcctggtaattactgaaagaagtctgctcttccagggcgagctattcctttaaccccttttgcttgctcttacttggaggttagcaaggagtgcgcggctctgcaatgtctgggaacccacctagagggcccccttgacgccagcacatcccctgtcaggcagcagtctctgcagctgagccaggctgctgcagagttaatgtacagtaccacggagcctgcaagtgtcctgagctgatcagagctggggcggcacagcccagggcagacaaggcggctgcgaggattccaaaggttctgctggaaattcggcgctgggggactccagcaggagcctgttgccattgtgttttaaaagcatgcaaggtctgtatagcttgggcatgagaatctttcagaagatgtcagagcatcagaataaatgacacctattggaaaactgaatttggggtgaaaaacaaaagagattgagagaggaaaaaaaagaaaagaaagacatcgggggaagaattcttagacaacgtctgacttgcagctgtgaaattcattttctttccaaggcaaaatatgaaaagctcccacatggttttgataataacaaaataaaggggattctgcagtgaaaagatcaatagcttagtcattttacttaaagagaacagccagccttattatggggttaggcagcagaaatgaatttcatcgtgacagcatcttctgaagtcatgatggtagttaatggtaatcttgtcctgcagagcagaaattactcattgccttcctacttttgcagttgaaccagcaattctgaaatctgggaaagaagttggctttggtgatacatggtttctagcccctctgcccaggcctttgtccgacacgtctcagacggtagcactgcgttaaagtgaccatacatgaatatgtgcctaagaaagaagaaaaagcaatattcatttctaaaggacagcatggcaaagcaacctgaagttttccatttcccttctaacacttctttaacaaggatatcaagaaactgtcttttgactcctttcttcccacattccagagtccttccttaaggatgcattaatttacactcaaggcggttagattttaccaggacaatatttgccaccatttaggattattagttgaactggttattttagtatgttgactaactagtggaacctaaatggatggacccatacctgcagtgctctgtgatgtttcttttttcaaatcctggaaggccttttgtaattgctatttgtttttattggtggggggagattttttttttttttttgggattcaatacttgttgcaataattgcccacgatagctgctcaaacaagagagttggaattcatctgtaaaaatcactacatgtaacgtaggagacaagaaaaatattaatgacagaagatctgcgaacatgatgcacgtgaataattttccctttagaaggcattcctggatatggtgagtaatcaatattcccttcagtttgtaaaactcagaattatcaaattccgtgacaggtaccagatgaggatttgtcttgaactagagtattggtatcaagtgagaatgaaaagtaaactgtgcaaaaccgaatattgtctgagaaagtaatggttatgcaataaaaatactttgttaatatgaagcatccccaaataagtcaagcatgaggacttgagaacatttaaattgctaatatttcatggaggaagaaaaaaactttgagaatggcaacaatttaataaatttttttaaagatgaggcttagggtttgttttttgttgttttgctatttttatttgaaaattccctggggaagggcacacatgaatttctgatatatcaatttgtctgaatttctaaaagaaggttaagggaaacttagaatgttgactcaattttaaaataatgctaaaatgtgttggtgcctcacagttaaggatattttagctattcaagaaatatttctaccagaatgaaccagtagaattctagtagaattctaacatatgaatcaggaagtgctcaggctctcatagaacttgcttagtgccttgatatttggtcatctattaaggttcaatgcaatgcattcaggtccctggacatgtgatatcatgtgccatttcttgctggagtttatgactaaatgtgtgtaggaactcattgctgagggtatttataagagcaaaaggtcattattttaaaattgcttgtttttgccatacctttagggtcagctggattctgactttcatagcagaaactttgtgaatgcataataaaggcacatgttaaggcttagtgtctgctaacatgggttgttttggaaatgcagtttgtctgattttgaaagtatatctttcaggtaaatgttctggctggactctggatgaataatagatacctaaatataggtttcggagggctttccagctgcttttatgacaatgtctcaaatgaaagctccctgagagcttaaggtaccaccaaaatcacctgctggtttgttacagagttttcggctttcagctaaaaaatccattgcagagaaggatgggaggcatcctctcccactctaggcaggtgcttattttctaacaacaccagatccatccagagtcgatgctgtggcgtatctaccttttttgctgaccagagctactatccccagtctctagaatgcttgggtgacatgcctgcaaacctcggtggcccacttccaactgcatcaccagagtttcctagtcagggggagccttggtgccattgccttgcttgttctgttggtgagggtcaggcatcagcaataaggtcctcattattcttacagacaaatttacatcaatagtctttaatcttgagattaaaagatcctggaaacagttcctggcacgtagtaggcatttgtcaattatttttcttctatgccttaggcttttcttcagagttcattttatacctcttaagatttgcttgggaggggaaattaccagtctcctttctatcaagtgtaccttgctacaaagcaacagtttttgttctacctaagttctgctgtttaagcccatttgtttatgttgtaatacataggatccatgtactctttgaatgcctgcaattataagcactttttatttttattgcattagcctcacctatacttttgactggaaagaaataagctattcaactctgaagttttggaaagaatgcaaatttgcttattcatgctcctctagatctgtaatacatatgtttgaaagctgtatggagaagttgagagtcctgttggttttcttttgtgcctggagttaggtaacccttcatctgcttcactgcatgtcgtaccaatctgttgttgttgttgtggccaaactaagccaatgtagaatgttaatgctctgtataactcctactcttcctgggccccttgcagggattcattaatatgatgttggactcaaaggaagaaggtggtggtttttttccaggtgacctaattaattttgtgcttggttcttgactttctcaatggttgttgttttcctcttatttatagcctccccttccagtactgcagtaagagattgtaggggtttgttgacagaaaaccctctttccctttgtcctactgtaagagcccctatagggtgagatttcaggctcgtgaattatcgtgcttagaataaaggtctcgccaaattgctcttttcatctccaaagactccccctatcctcattctcacatttagagccttttcttcgtgaagggaccgatcagaagttggcaacaggccagtgctaaggaataataaacattgtaaaagacatatgtgctttggtttcacgagccctagctcatctctagaaaggctctgtaccctttggagaggcgggacttggcatgtgctggtcctctttctgtcctgctttttgagaagcaagaatgagaaaaagctgagacacaggaggtctagggtagtcttcaaattttaccagaagtagtaattgaaatagaagcctgtgcacagagttcctacttgtactctcatccacctgccctagggctggtgtgttgattattgagcaatagtattacaaattcactctttatcagttatgagttaaagttaataagtggtcctattacttggtttaatagaacactaccccttccgtgctaaaagagtggtatgaagaatgtgtgtttcttctttgaagctacattagaaatattagctggaggattttattgcgaaggcttctttccattacacttttcagtctttttactgccaagccaaacaaagataagggtttgcctcactggatagataagtactatatagctcttcttatttttccttctggctagttgttagaatggagagatagcctggcattcaggaacaagtatggcatggttgaaagaagggaaatgcaagtcagctttctaggaatttaaatttcatgtagcagcagttaagaggacctttagaagcattatgacctggaatcacatgccagggtctaacatgaatgacctaacacagtgtgactaacatgttcagctttttgcctgacttaaaagatatataacaactttttataatcttatttgtaaaaatactataatttcatgccagaaacatcaaggctatgttgaatgcaattgaatttcatagctaaacaatttaggagggcattttatttaaatacctttgcatccttttaatgatggattcacatggctaaaaggacagtggaagatagaagctaaaggccctggctaggagaggctgtggaatgctgccatggagggcccctctgaggacaccagaggaagatttgggattaatgattgtggaaggtgattaatgatttgcttatttggtgcttagggtttaatttttaaaggtaggacatctaaatgttttaaactgtctttgtgatgctgagaggtaactccagtgaagaggcaaaatgaggtgactgtggcactttcactcaacatggaggcatctttttccttcttctaggaccctaaattctttcattagactgtccttttccaggtatcaatttctaaaaggtttagtctagaaagttatttgtttgattgttcctctatagaccaagcattcaattcataaactaactcatactgttttattctgttttgatctaaatcctttatggaatgaagcaagatataaatcagtatattgataatatattcatatatgtgttcataatttgcatgtatatgtgtttaaatctactaatataatgaatacgtattcagagaaagtcagaatggcctgccttctaatgaaaagataatccttcctatctagcctcatagagtttcatcttttaaggttttctcctcttcatacattgaaattacagaaactcaatccagaagtgcattttccagagtatgtgttctgaccaatacattatattttattagaattttagggggtgggagcaatattgagtttgatgactatgtatacgttgaaggaaatgacgtatcaagtctcatgtaagataatggagctttgctccttttagttaacttaaaattattgcagtgtctgcttgtcttccagtgaaattgcaggtaatagctgaccttgcttctttaacatctcttcctctgggttacagaacaacccagaaattctaaaatataaataccagactgccagcttaattctgaattcctgttggggccaaatacaatttacttgtaaacacttaggaccaataaagtttagatggagctcataattatacaaactcatctcgttcacaaatccctagggctcaatgttaaagtcagccattgtttaaggcagaaattcaggtttagatatagtgtagcaaagattttccattatatgagatatcgatcctattaaacataaaacttttctcttggctttctattttactgtcttttgttgccatcagctgtatgccccttaattttttctagtaataccttggaatttaaaaatgaaattacaaatgtttatgttttagtgtttttaaaaataattcgattaagtatgctatgatagaggagcaaagttgttattagtaatatcaatgtgcttacaacttatggaaatgaaaaatagtctttagtcctagcagcctttctgctgtagtaaaatagtttgtgcactttaaatcgctgtgaggttacatcttcaaaggactgagtggcataagccagggaggtcttagaaatcttacaaaaggaaaaaaataagaaattattcctcatcatatgaaaattatttactaacaatgtatgatgttttagcttcttttaaattcttcactttccactcctttttgcttcttccttttagttgactattactgagttacttacactaatgttgaggtatttgggttcagagaaaaataggcaagtaaaggaaaattgaaaatagtttcaaattctgagatgcaaagaagaacccaaaaaaactaaacaaccagttttttattgccataggtcgaatgttcctttttaaaaaaatccctcatccttttctctcctctttcaatcatatcccacaaacgttaatgctcattaatactctgtctagctatagcattatccacatttttgcaatagctcaaaaatgtctccaagccataactgctgcaactgcttataacttgatggactattaggtgacgtttccagttgtttgagaagtaccagcctataaacatacccaagacaatatattacaactagggattatgttgtgtaaaatttatacatatatatctctccatatatgatttcaaggatagataatctagagtctacataatcaggctattggctggaaacataaataaactaaaaaaaaataatttaaaaaaagcactccaggtttctaattcagcttctggagtgttaatgttttgtgtgaccttctgaaagctctttgagtttttaccacttttgaaaactattacagcagatatttacccacttcatgttaagaagtaggctattaaagaaaatctcatagcacattggtaataacaatttattagagaccagcctgaacaacatagtgagaccctgtctctctctctatttttttaaaggtagctgggcatggtggttcatgcctgtggtcccagttactcagggaggctaaggtgggagtgtctcttgaattcagaaggttgaggctacgataagccatgatcatgccactgcactccagcctgggcaagacagaaagaccctgtctcaaaaaaataaaagaagaatttattagaatgttgacaatgacatgccaaaatctcttgtataactatcatatacttcatggaagagatcaacactgttgagcactcctctgcatgccatatgttttcacataagttacatcctttaatggcaatataactttctgagaatttcttatccaaatccctgtttgcagatgaggaaggtaatgttcacagagattagataacttgctgaaagttcatatatctattgctagggaagctgacccactcaaaaccaggcctggcctgattttagagcccaatatatttttaatccaccatattgttcttgtggcagatgacttagcactcttgtttatggatctttttgaaaattagattagcagtagaccagagaaaataagcagatttaccctgttatttagcagcctggctaagtatgtaggatgcttactgaatgtgaatagcctttccttgagaaactcttccttttaatgttagaacaatgacctatacttagactgtgtcagcagctctttctgtattttctcagaatgagaaatttaaaaggaatttgtggtgaactctgtttccaaggtcactgtggcctataggatcctttcactaaaaagtgcctctctggacgatatattaggaaaggtgtcacactttgaacagatgaagtagaaatgcaaactacagtacttggtgaatggacagagcctctgttcaaagcaaaagtcactcttcccactgggtacacacttggtgtgtggagcatagatgaattcagctctattcaccatctctgcggggcattgttgagccctgttcaaactgcctatctctggccctgctttgatacgggctccagctttactttgtgacagatgaaatggttttgagaatgctttgccaaaaataaaagatcatccacattttaggttttgctgccataattattactttcttcaaaatattcaactaattgtatgtctttaaacttcattttgtgctcaagtaaagaatattagtattatctgaaatcagatccaattgccaaagaagcattttaatcataaaatagcccaatttctgagttactgaaaaatgtcatggttagtgaattatattggaacaggtggaacacactgagttatttattcataggggatgcccagatgaatgtaataagagtcctgccttggagatactcataaactagtctggagaacagccacagaaacaaataattacagtatagtatggagcatattaatatagatatatacaagttgttacaggagtcagaaggagaaacaacttaactgacttgatccaaataccttaagtttcaaagtgaaaatatatttgatggatttgggaattagtagttactgataatacttcagagagtggtttaagggagtgtctgggggtaagttatatttcaggggtaataaaagcagagaaaagttgtgcaaactacttctttcaaaattttgcttaagaacgaaggaggaggagaagaagaggaggaaagaggagaaggagaggagaaaaacacagtagctagtgaagaacaccaagcacttttaagagtaggaagcatgtccctaaggaaatattctgatacagagctgggaaacttgtggacatgacaccctctgggatagggggaggaaaaggagggagaatgcagataatgtggagattaggtaggtggaaggagagcctgagggagtttttgttttatgccctgtgttttctctgggaagtattaaatggaattcaagatcacatctcagaaagaggaccagggaggagcaggtggaggagcttagtaagatgatggaacagctactagggggaattggaaaggttattgaagagagagtacaagacagtcaaacaagttggaaaaaggtcagtgatgttgaatgaatatatccagtcaataaaagacgttttactctacttgagaaattatttacacaaagtattatgtcagggaaatgagtagagatgtgacagaaatgttacaattcttaattattaaatttgaaactgttttgtgatgagaatgtctcctatggattgtgtttcttgggattccaaagaatacagagttgatcttaattgttgttgttgttttatttggtagtggtggaaactgttttatgaacatattaattagattgcagttccattttcatgacctgattttttgaaaatgtgagatttcctgtgctgccttgaaataactcttgggtgacaaacagaagctttaagatgtttgctttgaattttatcttcaaatgaataaaaatcacagtgggaagaaaagccaaaatgattcagctttgctccctttttaataggaacctttctgtggtttatgttagaatgtcacaaatccatatatatgtaacctgcttttacaaaaatttcttcaaaaccgctatgaagcttacttgaaagtgtcaccagtctctgagaaatgtactggaaataaggaaacataatatgactttaaccagaactgatgtaacccagtttaaatatttatacatttaaattctcttttatgtctccaagataaataggagaaaatgacaaataaaatatgtaagttaagggatattattaaatagccttataattttctaggtcatgagaataaaccctggaggatactgtgactttagccaatattatgaattcctttcatctcttctaatcatctcagcagagcttccgctattattgtcagcattcagtgctcaccactactttatacagagcttgctttgtagaatttttgctgtggctctaaaactctaaataagattctaaaagtcttagtcacttgtcagggaacttcattcttcctctcccttgagtctccatatttttcttttctaaatatgaaaatgagaaggttgacttaactgatcactaaggtgctataaaaatctatgatcttatatcttacctagttaatttactcatttctgtcttattcaggcataattgttcttccattaaaggtaatgcagagaaaccacacataaatcaacaaacacctccaggactgagctctgatgcttttctcaagtatttggcctctcctatggaatatccttagcctgtctaccttgggtattttgcttaattccttctccacaaaacctaactttaaatggcagcctttttcatggggaagacagcagcgttatgcccgttaatgctgatatccacagtatttgagaaaacatattccatatgcaacctatacatttctcatatcttcccaactcttctcttgataaaggtctcaggcccttcctttttcatatatcctccatttaatttaaggaaataacatgatatgaagtcctcaatcttaagaaccttgtcattgggttgctcactatgtttaaaacaaataattggcgtaatgatggagagtcccttgatgttctagagaagaaaggaaagctagcaatgtgacagtgggcaaattgagaaaaccgtagtggtattgagatcagtgaaagagacctcttacaagtcctaaagtaaggcatttgagtcttaaacctttgggtgtgttaattttaaaagaagaaaatatttgtgggaaaagtcctattttttagaaaataatctgtgccagatttgatttttgagagaggttgaatgctaagttgcctcaggatgtcatcatttgaaagggtgaccacattctgtgagatcttcactgcacacaaccttttgcttcaaagaactttctgagaccaagctagcctttgagaccaggtattaacattataatctgttctattcattgcagtagccacctcgactacttttttctactttataccacaatacccagcatggtgttgtacttaataggtactttttaaattttttcttaataaataattatgtgtacagaaaagaatgataaataaaaattatattgtcaggggaaattttaattaaataactttatatttttcaaataatgttattgtgctatgttttgagataaggtagggtcgtatgctataaaaaataatacagataataactatcacatttaacaggttatccattccaagtatagactaatttttttatagacatcattttacttaatcatcccccaagtctgtggcaagggcttgttatctacttactaagggtgcaaccttgggtcacttatctaacctctccatgatctgtaacatagggacagtaaatagttctcattgcatagggttgctgtgaagattaaatgagaaaaccagtctagtgcttagaacacctgtcactcagtaagtatccaataaatattgttatagtacagattaggcaactagctgtgaatggttaaccaggttgcctagggtaatcagtggcaggccacttccaacctagatcttacccattaactataggttgcttggaggtctaaactgcctcttctatatcacattcttgttcagtaaatacagggacaataccttgggttaagtttgaattatgagggataatttatacctcctcatctctcaagcctcagcaagaatcgactgatgtgccctcccatgttgagtcagtgcctaccttatacaggatggattttctgtttatgactgtcttactcaggccctgcttcattagattctctgttcttagcacagtgcctgacacatagtaggtgctcaataaaatgattttagagtaaacattacttttccagaattgtgtcctgggaatttacggcttttaatattaatttcaggtttttaggatatagcccatgtttttggggggatagatactgtttctataaaaattgtcatcttgagcataaataattcccacatatcttgatttctgtcacttgggagagtttaactggatttgtagaagcaaccatcctgccgaactgggtgtatctgtaaaatctaaatgctattgctacaaatcaccttatctaagacaccatttcttcaaaactaataactagctcattcactttcatataggaatctttctttccttgaagatatgtatgttttatcttgctggtgagataaaagtctgtaaattatctccacagctggctctgatgcttgattatgcccctttctgcatctataacattgatgtttcattttaattacttttcatcacagtacatgatgtggtcttcagacatagaccagcctctacgtgtggctcttcgttctttttatacatctttcactgtcaaactaagctctaaaaatcatctccctaatatctcttcacttgccaagaaaatgtactagctttgtattatatgtaatacagcataaagctctgcctcatctggcctcctcctttctagtctcattgtagaaatgataatttttattaatattatcagtgttaattaatttctctcattattctagcatacatatcctatatttgagtttttaaatatatcaattctttagtatagtggttataatcacactatatatgtatagaatgaggttttattctcactttattatgaaagagtatcaataactattttatatcattatatgtagttttgtcagagaacatcctgaaaaattaacttcaatgttttaaaaagccatagttctcagtgtgatggagatggtgaggattggagaatgtcattagggaaggcagttgtatcatttatcagaaataactgcaagactttgttggggggaaagtaataaggagtatgaaaatctggaggttgaagagtgggtaggaagaggaagtgacaggtatattttgataaagcattcgagggtttcatacctctctctcttaaccagtagtacaatgcaagggaaagatcccatgctttaaagctgtattgaaccaagttcaaattcaactctgatgctgactggttaactttgagcaaatcaccttttatgagcatcacttaactcatttataagagaaaaatagaacagttccaatcacccagatttactgtaaggattcaatgagataatacattatttaatttgtcatttttaaaccgcagcttttcccaggcagcatttaagacaaccaacaaagttatatgtgcataacttatagggagaatgttgatgaagggcaaagagaaataaggtatgatgttcctactcacatatgtatgtaatagttaaaaaatatatatatatatattacctttacaaacggcaccagaatcctcttggggaaggaagaaaaatgtctttgctagaagatatttatatatatatatatataaatatatatttatatatatatatataaatatatatttatatatatatataaatatatatttatatatataaatatatatataaatatatatatttttatatataaatatatataaatatatatttttatatatatatatatatatatatttttttttgagacagagtctccctttgttgtccaggctggagtgcagtggtgtgatgtcatcccactgcaacctctgcctcccagtttcaagcggttctcctagctcagcctcccgagttgctgggactacgcatgcaagctgccacacccagctaatttttgtatttttagtaaagatggggtttcaccatgttggcctggctggtctcgaactcctgaccccaggtgatccacccatctcagcctcccaaagtgctaggattacaggagtgagtcactgcagctggcctagaagagctattttgaacgtgcccttgggataggaagaaagtccctgaggatctgactataggtaggtgctcaagtgctctaagggtgaaaacttctctgcataacagaagaagaatttagtgctaaagagccaatgagaatgatggagatgaggcagagaaattaggagagaggacaggatgaggaaaattcgccctgggaaggctgagaactgcgggtatactccataaacagatccctccccagtactgacagtggttcggtgggtgaggggtattggggagggtacagggagttgctaggggtgggaagaccactaatatatgtatgtcttacttgaagcctcaggagtacctgaagtaagtgattttgatggtgttggtggcatgtgaatcaaaatgagctgtgttgtgttggcaaagcaggtcaatgagcccagcctttaggaaattatcagaaatttagaggtgagttttgggattcttactggtcatgaaattaggaagttcaaatcaattttgtttagatctcaagggaggcagagggccttccatctttcaagagttaagcagaccatgaagtccaagggtatgcaagatggaatgtaaagttctcactaagcttcctaggatccagggtaaatcaggaagcttaaacacaaatccccgtgtccattggataaacaatttgatggatcagggaagcacaccacttatgatactaagatcagaaagaaatttgtcctaagttgtgcataaagattaatgatatacatatataaatcatggtatctgctcaacttagtgtgtttgatatattttagttcctctcctgtcccttttttcccctatggatttctgtggaagattgtagtatatttgaaagttctttgaaaattgtaaatactattgttagtttataattaaaagaaagcggccgggcgtggtggctcacgcctgtaatcccagcactttgggaggccgaggcgggtggatcacgaggtcaggagatcgagaccatcttggctaatatggtgaagccccgtctctactaaaaatacaaaaaattagctgggcgtggtggcgggcgcctgtagtcccagctactcgggatgctgaggcaggagaatggcgtgaacccgggaggcggagcttgcagtgagcccagatagcgccactgcagtccggcctgggcgaaagagcaagactccgtctcaaaaacaaaaacaaaaacaaaaacaaaacaaaacaaaacaaaaaacctgtgtaccagatttcattaaaatctgattaaatactattaaagaaagtataataaaatagatagtataagaaaaggataatccaaataaaaaatatgtttcttattaaaaaatggtatgtcttgccaaattttgaagttaaaagcacagcattctcacttctttaacccaacttatagcccattatagcactagattttagaatcctgagtcctatgccatctgtaatggcaacagtcttacagggtgatacaaccttttgtaattcttaaggagacttgaatttttgaggcaaatgttgagtctatacgtggacatttgttgtgtaagagtggaagtggaagtcaaaattctgaacaaggttgctcccaataagatctgtcagctcacaagattgcttccctaggcttgaaatgtttcaagcacaaattcaattcataaggaaaatgagaatcatgaaaatgattatgaaatagcaagcagtctggaaagaggatgtagacgaatgccaaagcttctggaatttatgaaatatttccatttatggggccaggtgaaataagttgttctttcagaaatgtgtgacatggctattatatattatccccctaaaactatttgatcataaaacaaaacaacaaaaacaaaaactgataaacagcaatgacaaaacaactaaataaaaaagaaatgcagttcttgaatacaggatataaaggctcagtgcactttttcattttcttattatttcttttccctggctaggtgagttggctgttttatattggcactaagagtttgataccactactagaatagtcaagtatttgacctggccatgagtaaaagatgtttgattgacagatgagtctatctgtgtcaaacagctttaccttgagaaaaatcacaactttgaaagcagtaacacttcaaaagaatattgaagattgtggccactttcccccacctctccccaaaatctatcttcattcaagttcattataagcagctcctttgggtaatttgggttgcgtgctttctccaccccttctgtatccttggcttcttcagagcgtcaatcaagacaagcaaaagattcaagaaaaaaagggaaatgacctttcagtacctgagtcttcacaccaattcatcattgctaagtgctccaaaactgctgagtacagtatttaggaagtgtccagtacatcagcctggcatatattgttcttaacttgaggttactaatgcctattgcaaatgtgctttacgtcagccaaatgatgtgtttaaaaacctctatgtctagcatgaagaagaatctctttcattctcatgttaccttaaaagattttcataccaatatacatcagggaggagcaaatttttgtttcatatgttacacatgttatggtgcacatgaagactggaaacggtagttatttgttgggcatgtgtatgaattagtatgtaaaatacacagcatttttttctcttctaagttactaaatattagatatttaatgtatttcttttgctttgctaatttattcaaatgtaatcctgactaatccattattttgttaacatgtctacttgattaatgtgtttttcccctcttctaattctgatccacaaattttatagctattcattgtattacttaatctaagtccactaaagattatccttattcatgtttctccattaaagacaacgataatatcattgagttagcttagttcggatagaaatttggctagcattcattatttgattttcttggagttttgcaatttttttttttttgcatatttgtcaacattgtatactcctgaaagcattgtgtttaaaatacctatttcttgatcagtagaattgatatagctgacttacacggatcaataacatgattttaagagcatttcaaggaaatctctcatctgcattgtctttttttctaacacagtttgcactatttacaagtgaaaattttatattactttacatattttcctgtaaaaattagaaaactgtattctttggcacccgaatgtgtccttgaattattaatttgttaattttgtatgacatccttatttattagagaagcaataatatttctcatgggaatgcatgtattaatactttcagaggtccagaaagtatcaggagattaaatactgagattaaagagtactctcttcccactattatgttcagttctgattttccagctgtgtagctagaacaaagaaagaatgtgggttttttttaaagaataagacaaggctagaaggtatgcccttgtgagggcgccactgactgtgtcatcacaggagggccctgatacatgaatattcggtctccaggaagccaagtatgatattcacaaccacataataatgtgctaacctcattcacggtaatcacagataatgtagtatttgtgtctgccatacagttttgaaggtaaaatatggaacctattttggaaatttcacataacatcttaagctgtattaatagaaccagaataacccaaaataaagaggtaatgaatgcacttgaccctgcatcattcagacctcagctggaatattgtgcttccttttgggctgcagacaaacagaagaggactcaggagagtgacaagagaggaagcaagctcatgccttgtcacatataaagtggttgaaagactgcaattgttagagaaaatgatgcagtaattgaaggatgggtactgggaagaggctagttctttgaggctgctaatctgaaatataacaagtggatgcacctgcagtaaaagagattaagccccagaatgagtctggatgttctaatggtcagaacaggcatttcatatgacatggcctgcattggtccaggtggcgaagtaaggatggacaaacatgcgttgtttgcaatgataaaaaatcataagtagatgataacattgatttgctgaaatttttctcttttttgtttggtgtaaaactttatatgtcgtactttttgccttgtggtttttttgtatcttaggacaaaggtattcttaatccctttctttgtcttcttgaaagatgcaaccatgcagaaaatgcatacctcctgtaaattgtttcctgtcttttagtaaacctttgtttaaatgagtcatatgtttagcaattttaacattttaacttggctctaattaatgataatatagcgtgatttatggtcttctaaagaaatgtagacatagaaaatggagatagaggttaacatgtgaagaagagtttgtattttgggttagaaaattaaatattggcttatgtcagtaagattaggccttactatttgattgtacgagtttactttaaatttctaggctttcagggctttgtaaagataaattttattttaaaacagctttagatttgcagaaaaatggcaaagatagtgcagggagtttccatatacccctcacccactgccttttattaaagtcttatatgagtatgatacttttgttacaatgaatgaaccagtattggtacattattattatttaaagtccctattcattcatatatccttagttttacctaaggttctttttttctattccagggccccactcaggataccacattgcatttagttctcgtgtttcatttatctttgctatagaattttctcagattttccttgtttttcattaccttggcagttttgaggagtactgattaggtattttgtagaatgtctctcagttggaattttctgattgatttttcatgattagactgtagttagtgttttggggagagagaccacagagggtaatgtgccatttttccatcacactgtcaacatgactaaagatgttaaccttgatcacctgatcgaggtggatttggtcaggtttttccactataaatgtattatttttccttatttttattattttcatacctaccctttggaaggaagtcatgataaacaacccacacttaagagggtgttatactccatctccttgaaggcagagaatctacataaaatatttgcaattcttctccacagaagatttgcttattctccctcatttaattattcagcatttatgtatatcagtatggactcatggatatttattttatgcttaggttataatccactactgtcatactaatcgtgctgtgaaattgttccagctttggccattgggtactatttcttgtgtccctttgatacatccccacaattgtggtggttttgttttctgttttttgtttgttttgttttgatgcactttcatcctttctagcattacacaatacttgaggcttatcaacaatataactccttcctcatcatagattcagccatttctccaaggagcacacgttcctttcattggaaaatggtattaaaaaccaagatttgagcaataggtgtgttcattgtttttgggttgtcatttccttttggccttcttggctgacagagcaaggacatatatttgtgtataccaacctgtgtatgtacacatatctaacaatcaggaagcataaatagatagatgatagatagataagcattagttcatactgatattttcaaatctaactcattaccacatgggtcattctagcttcttcctcttgcttatctataatcttccactccaacagtgaaaaactaccatccatcatttgcttacttaattgttcaattccagtggtgctgttccatttatccttactgaagttgaaatacataaatataagctgaatttttctcaaacccttagaaaaattatttttcccccaaaatgttttttaccctgcaaactcttaagattttaaaatgtatttgtgtcccaaatgtttttctgtacataaaaattgatatagtcaactttatattgtttgcagttaacttgggacatggataatggaaattctcagataattccacaatttaagtttatctcttgctttcattatttctaatcagcatactctccatatgacaactatatctatgataagaaaattgacttctttacctataaatctctgtactttcttgacagacaccaaagaactacatgttgactgtatcttgctggtaacttaaggagaatagtaacttgtagtttccacctttagcaactggacattggccatactctgatttaccaagagagtccttgtaatcacaaaggaaagcagcgatttggcttcagatattaaagcaactttttttgacgtggctagatggttaggaacacactgaagaatagattttcagtaatgagccatactttcaatgaacgtcccaaggaaaacaattttaagatcttgcataaaatagttcatatgcctcaaatttgcatttaattcttacattaggttgaaagctcatgtagaaaacatgtaatgtaaaaattggagagcccaagaacacagtcatttccccttgggtgctaacaaaaatatactacccaacagtgcctttgtttgcagtctaatattttagaaggaaaaaaagaccccacaagcaaacatgttttttttttcttagtccagaaagaagaaatacagtgtgaacataatacttagggtagacaaaatggccaaaatagattaagttggcatcctttttagctgcagcttccttaaccttgtaccacaccctgacatcatcttcctacatggccacacctcatccccccatagccaaacattatttgcattcatcactcattcgtagatgccaaatcagacatggttcttgcccctatggagtttatgattaactggggaagacatgcattaatcaaattctctttctctctctctctcattctctcacacacacacacacacacacacacacacacacacacacacacacacacatgaaactgtgactggatcagatgctacgggagaaagacacacagggttcaaaaatctgtgaagggtttttttatctgttcagggaaaatcaggaatgtcttctctgaggatgagtagttcaggctgtgatttgcaggatcagtaagaattaaccaggaaaagaaggcaagagagagaaccttatgtggtgaatgaacaaatgtttaatataaaggcagcagaagagccagggtggaggcaggcacagaggtgggagataaggctctggtggccatgctaaagatccttacttcaccctgacagtgatggatcatcacaacatttccaagatcaagaatgcacttcccatctgtgtttcctctaaagtcaaaatatggcccatctttcaaaaggaaaattcaaatgttacccattcagtcttctaacactttcatttcctaatctaattagaaaagatcattctggctaagaggtggtatagtagtttaacccacccactcatatgcatgtgtttgtatttatatataaaattttattttcacatttctttttcctagtggcattagcaaaagcactcccagtttcattgagtctcttttaagttttgcttcccctctcctcctctcttcactatgctctgctgtcttggtgtctccccactactcatgtactctccctccatttctcaattctcatatgaggggaggtgccccagagggtgacgaaggacagtgtggcagaggacaggaggaagaaaacataggcacagctgcacttcagcattctgaagctgtaatcatcctgagcatctgtccagggacttccttgcccagttgctttgccatctgtacttgaagccaaggagcatcaggtgctttgcctttcctcaccaggcttacgccatagccttttcaccccactacccacacctcccagtgatgctgcaactatttctcctctgggctccatgcagtaactttctgggtttttttggttgttgttttagagcatttttgtagacagggttttactcagtcatccagactggagtacagtggtgcagttatggctcactgtagccttaacctcctgagctcaaggcatcctcccacttcagcctctcaagtaggtgggactacaggtgcaaaccaacatgcctggctcattttttatttttttgtaaatatagggtttttccatgttgcccaagttggttttgatctcccgggctcaagcgatcctcctggttcagcctcccaaaatgttgggattataggcattatccactgtgcctggcccagtaactttctaaatagtgtacaggcctccagtctcaccacctgtcccattctccttctctttccttctgcagagacctaagagccaagcggagcccatctccttcctacacattcttccagcctctttaggacctgatttcacaacctcatgtgccacaccccagctgcaccctcctggtggaaagtgttttgcagcttcttaaagatatcattctgcttcattcatcaacctttgtccatggtgttccttctgactagaatgtgtcccccaacccctttgcctggtgagaccctcctcttcctttgagacccatcagaaggcttgtctcttcttggaagcttctcaccccactccagtgctgcatccctagtttctgtgcatcccctgcaacctgtgcatcactttttcaaacatcgctcctcaagtagcattgtgcatgctgttttcttgcctttctcactcacacaaatgggagtttcctgggggccctttgtcatcaccacctgcctgactggatacactaacactcagcctacctgccacctacttggaaccttacaggtgtttctttgattaattaattaattcatgttttctcctcttctggtcagttcttccactttacctgtgcttgtttggatatgcagagctctagctggcgagagtgtccttctggctagattgtctcaccaaaaagagaatgggttttccccatccgggtgtctcttaattttttcttccactcgtgtttggacaaaattatttattgactggaaggaccacatggcaactcttcatggctttgaggccccttaatgagtgtccaagggagattctctctcacttccaagttcatggcagacatttacctacccagtcagcttgaactgagctcatagaagttttatttctggcttttgcggatcattttttatgctgttcctctcacctgaagctccctttctatctctccctagttggataatagtacacatattaaatgtgtaccttgtaccaagtatgctgagacctgcttataactaattttgcttgatcttcatgaatagtgttttgaaatagcatttttctatccctgcagataggaaaactagaaaacaaagaataagtaacttccccaagctcacatgacttgtaagtggcagagctgggatttgaacccaagcccctctgaagctaaagcctgtagagtacatgctcccttcctccacatcacactgcccctgcttgttcacactcaatgtgagaatccacttctcaagtttgtcttgcttattccaacctgttttgcaatgaatctctttcaacagctctatagttcctggcactcacttggcatccatcattttctatgttgtcatgtttggtatcttttcatgtatgtaatgtgcatctcttcttaggagtaagaccagaacttttctgctctgcagttttctccctgtgagggatggtgaaacttggtggctaagagcatggtttatacagacagacttcttaggtttatattctggctctcctctgtacttgctgtatcagctagggctgatgtcttcacttttttatgattccatttctacctctgtacaataaggcaaatatgaatacttacctcagagtgttgttgtgaagatggaatgaattaatggccataaagcacttacagctgtgtctggtacatagtgaccactcactaatggtcacttataattccttcacaacctgtaagggtcctttccacccaggtgatgtccctatgtctcaactgaatgactggttagggatatctttccatgggctactgtggctgcagataattgcattcttatttgagagttatgttaactagtgtgggcttttatttgcttctctctttctatcaatgagtcctgctgcttcaaccctgggttaactgaaatttgaaacctttttctactcaaattcctttgatgctgaaattcctctgcggtcacagctaagcactttgtgtggtaaccttctcttctgtcctcaggcctgctgagatcatctgctcagcagcatgtctgacacctgttgccacctcacccagccacttccttggtgacctggcaatgcccagaggggccctgccagcttggagccctgtggcaatgctgtttgattcagcaaactgatagccttctgacatcctttcttcattttagcagccaaatcacatgcaccttaatatttatcaatagctaagcaacaccggaaggaagtgagacagagcctctgggctagtcactatctctgattttacagaatggttaagccaggtgtaaaatatctcacaataacatgccctgttgtcctgaggattcaattccaccgagatataattaccatatgaggaagtgagaaatagggtttctttctaatacacagaaaatagaaaataagatgcttttcttggccactgttatcagtttcctgttaaggttctgctttgtttaaaacagtcctgttttgcttaaaaacaaactctaaggaatttttctaaaacatgactcaacctaactaggtatatatactgtactttaaagtgaacatatttgaaataattgtgagtgacaaagagacggaaaaacatagattttgaaactagcattattctaatgatttttatcccagtggtttatttggaaatgaatttccattcacaacatcttcatttgtcttctaattttcatgcaatttgaaagggttagtttccttacccacaggatcatcctggtcaaatctcaaaagattggctagggcattctgattttacaggcaaatttatattttgccgtttcaggaaataattccttcatggttatcttttataaagagcttatttgtataatatatacacatagtatatatcaaataaaagatctggtgttataaacataagaataagcaatttcccttttgtgataggaatatgaaattccttctggtagaggacgtttaagagcatgtccaaagaatggctaatcaatgaattctctcattttgtaaggagacacttagatgcatttctgaaaaaaacaaaacaaaacaaaacaaaacaaaaaacactttgggctttctctgtattcttcaagcatttctaaacatttattgacatatgcagtagagaaaaactggtatcaggaggaaggcagtaagtagccagcagtcacaaggtacaaagaataaaatgcatgcaaacatgtacagtattcactttcaggagttaatctacattttatttaatttttttttttttttttgacagcgtttcactcttgttgcccaggctggagtgcagtggtgcgatctcagctcactgcaacatctgcctcccgggttcaagcaattctccggcctcagcctcccaaatagctgggattacaggcatatgccaccatgcctggctaatttttttgaatttttagtagagacgggtttttgccatgttggtcaggctggtctcaaactcctgaccacaggtgatctgcctgcctcggctgcccaaagtgctggaattacaggcgtgagccaccatgcctggtcccttttaaaatattttaacactgagaccatattactgatgtactacttctttctaaaagtaattagaataaatgtacaccctcttctttaaactttgcatttttcaaatttccaaaaacaaaaactaattataagtaaatccataagcaaaacgctgttaattaccacttccaaaatctggaagcggtgacttgctttactaagacaagaaactttagacaggtgaatacttttaacaaggaacacacttaactttgtctaattgagcaaattacaaatcagagctagtagcttgttaattataagaatatctccattacttgaatacgtgtactagtcatggtaggcaaaataatactccaataacggacgaccccactgtggatctgagaaccccgcaggccagcagtctccatgtgattgccaaaagcaatgccgccatataaaccacaggtgtctaccttcaccatgacagaagaaagggttagagattccagaagtcacaattaaatgcttccaccccgaaaagtggatcatatttcattttccaaagcaatgcaactttgttaacctcaaagaggcagggaagtacaattttcctgtggggttggaagaagaaaactggaaattggtgaacagttttgaaatgtctgccataacttttaagtgaggaacttagtgttctcttactctgtcatgtttttaaatatctttttgattgaaatctttcaaggctttccagatccctgaagataaaatacaaactctccaacaagaccttttggccatcaggaacgcagcacctggctctctcactagtatcctctctctgtttgccatgtcccattaagactgtctccagaaacaatgaatttattgttgcctgtttcctgctagcttttccccgtatttacacagtttgctttatctgctgggattacccttccctgactatgctcaatctctatctcccttggcaattctcctccaggccccagacctgagaactggaccagtgctctgctctctcctctgagcttcaccacatcctgtgaaaacttgaacctaattcttactaggttttaatcaactgtttacctgtcttttctccccactaaagatgaaaagtcgcagagatagcggagaacaagaaccagatctcacagtcatggtgccaaaagagtatctaaccctgaattggagttcaatacatacttgttgaatgaatgagtgagtgaatgaatgaatgggttttttttgtgctttcatctacctgattggtagcatattcaggacagtatgtttttctcacctttttacatgctataagacataaaacagataatgcgtgtagtgggttcataataaaggtttaaataaactttacctacagttttatcactaggaatatatttctgatatctattacctttgaactttttatgccagattatgtttaaaaacatggtgtcactcgtaagccacatctgggactgattttcatggattgattaaactttacatttcttcggagtattcactgccaagccctctggtgccatgtcctaaaccaaatatttcagaaacattgcaaaacaaggctgcccttgtgctttggaaacgctttcaaatgacatgccattcctttcaacttgaatctattaaagacttgaaattgtagcaatccattggactatatgtcaagaaactggtatttttaaagggtggcatgtttcttcatttatatgtaaattatttccatgtgctttggagagaaaaatggaaattttgtgaacgtacttagcccttaaagaatgtgattgatccttgatgatgtcgttccagacaacaacaaatacacaagaactctttttgagtgctgtaagaagcttctcaaaatttccagtataatcctaggaaaacatttttttttaatcttttctaatcaggaagtctttaaagtgtattttatcaaaatgttcagtattgtggaaacatactcatgagctattagctatagctgacttttgaggttataggtgaaaagttttcacatcaggaagtttcatgtagaacaaccagcgtcattcacgctcatatctgtggcttatatccaagagggccactggaggcttaggggctttgaagttaacagcatgaaacttctccaaaacaaacatttaatttttttctgttcgtttccttaaacaaagtccatgtaataaatgaaataattttgaagaacattgtaatgaatcccacataccagtgggtcccaaattactggaaatcataacatggctcatgtgaagaaagaattatactattttcaagctgttgtatgttaaactattatagtaagtagcataattggcatatattttaggccgtattttcaataaatcaatatttttgctcaaaaggcaaaatttaataatttaataatctcataaggtgaaggatggacaggtaccatgttaggaatttgacatgtgttgttgctaatagactcatttaataaatgaagtaaatgatattaagcagtttcctcatgaccacagagcacagagccataatttgatttaaatatgagtatttctggctcatgctctttctctttctacctattgccattagtgaaggctgcatttagtttttttttcaagaagtgtctagcttacaattttgagcttcactacccccaacctcatacacacctcatgtggcttagagctatataaaatccatgttttttaaatacttctaaaattggacattcatattatgtgtatgatgttttacatatagtatgagtgcagtgaaagttagtttccttaagttttcctgaattcagctgttaccctagcatgactgcttcagcgaagagataagagcttctttgactttttccactggaatttttcatgccagaagaaattgaacatgtgagcctggtgtctggaagagtagcctggatttatggtatcagatgcacatttttaacaccttcagttttctctttaaaatatctcttcaatcccttacttttctctatttgtttcaacattaaaatatgttatttttcttcaaattgttggcattgacacctcttctacaattcccagtcatctgcatgctactgcttcagaggaatagtcttatatatagaaaatactttttttttctcagcacatttatatctaaacaagagaatgatatgcttttacccagttatctgcgtggctcacttccttcaaggcttcaccccaaagctacttcaatgtaacattttctatccattagattgagaactgcagttttaatccctaaccccactcccagactcccctgctaaagttttctctattgtccttgtcattttctgatataccttctaatttacctatttattttgtttaatattcatatcccttcgactggaatgtgaactccaacaaaagttcatatttattgtcttgttgtatctccatagctacagtagcacttaatatatagtagatgctcaggaaagatttataggaagaaaaaatgaaagcatggtttgcaataaatctaaatctataaacattccttttttagtagtattgttaaaccttacggttcctgtacaaccaggtgtatgccctctagagccaccaataatattccaatattaaatatacataattttataaacaggtgtgattttaatgtctctagacctttccaaccagaaaagctgaatccaggtactgctggtctttttccttccataggttctcattttccctgatgcagttattgccttttctgtttatactttcttccctttaggtgacttcacttacaaatataggaatgctgattcatgtttagcattgtgtggtttcagtatttattttctgtatttccacattgctattttagctcattctttaattaaataaaatgccttattctctcacagtatcagcaactaaaagaaggatacatcacctacagttgttagtgtgaactgcttatattaactcataggatatatattggtagacataaacctactgactaaattatttctgaagtatactctacaaaccatcattgtatttttacatttgacaaagtggaaaaaaaaaaacctggccacaatctttaaccctgcccagtgtctctggcttttaggcacacagccagtcggcaatggcggcaggggtggcatataaagattctagatctcaaaatgccaacctggccagaaaataaaactcactatgtgataccattggaacaagcttctataccaatgtagggggtgatggaggataatatacattgcaaatttatgtaaaaccagaccatgtggtatttccaatagttgttacaacattgcttaaaatgatataaatggccttatggataaaagtagaagtttaattttagaatagttcctattttaagactagatttagcaaaaatccttatggcatatgtttactcttggggaaccttgagagatagtgaacaagaaacgttagatcatagacttcttggctgcaaaaagtttatttatttcatcattttactcgtattccttttattatttgaaaagctttgtataaaggatttttagagatggcatttcattaaggttatatttattagaaaacaaacttgaataatttaaaattacaaaaggtaagtcattttatgtatttgcctacttgtttttgttttctccctgccaccctccctttcttcctttgtccttcccttcctcccttccatccttccatcctttctttattcatgccctgcctatttagaaaaggatttgcagtaagttacaaaaagtacaaagtcaataatttttttttaattcagaatgttaaaaagagaaaattgggtgaagagaaagtgaatatttcaataataagagtcatagtgcttcctctgaaggagcccagaaacccatctcatagttacgtggtggccaaacttagcaggaaaacaaaagaaatgctagacgagaagaacacaacatccatttctcaggaaagactaagttttcctcgtacagaaccctgaaatgtattctcccctgggatactgtttggataaacagtgagtgctgtaatagtcaatgtctttacccactgcttcacagcaaagcagaattcccaaggtaagaatgtgaccatgtaacctcattgcctcaccattgttctctccactctaatatttcagtactaaatgtgtgtgtctcttagggttgctgtgctgaataagtgagagtcacctggcacagcagacatctagtgtgtgctaaagaaatgtacagagaatgagagagaatttgaataaaaaatgtaaatagaatattatacagaagttaggaattaattcacaagtgtgtaagagatactctgtctcagatgtgcaggccactagtagtgcagtgtgacactcactgcctctcaagagaacttagtagtcagaaaagtgaagaaatgacatagcttttttacactatattatgtagaaagcttattttttaatgttaaccaagagcaaggtccataaactctaataccttccagaaagcacaaaagacattgagatacatttagagaaatagaggaaactgagctagatattcacgtgaaataggatcattccacatcttccagcaaataaattgaggtgaccaaggtcccagggagcacagatggtcatattctaatgaagctctggctcaaaaacacacaagctgaaaacaaggcgaggatgcttcataacaatgtccttttgtaggagaagtgaggattagtgatgagggtaggagtggagcaagagacagggattaatttgcatagccaccttggaatcccaaactgtcaatggtgtcagtgatgctgtttgcttgagtccctaaagggttgaatgaaagaagttaactagatacagagttcacagaaggtcaataatcttagctttccaacaagttggagatcggggtaaggagaagggcagaccttaagaaaagagttatacttattgccaggaaacagtgcttccttttgctgtttttccacaaacagatttacctttgccctatgcatttcatcttattttaaaaaacaaaacttttattttaggttcaggggtacatatggagattttttttaatataggtaagctcctgtcatgggggtttgttgtacagattatttcatcacccaggaactaagcctactacccaatagttattttctctggttgtctccctcataccaccctccaccctctggtaggccccagtatgctgatcctctttgtgtccatgtattttcattatttagctcccacttacaagtgagagcatacagtatttggttttgtgttcctgcgttagtttgctaaggataatgcctctagctccatccacgttttgcagaggacatgattgcatttttgtatgactgtatagcattccattatgtacctgtaccacattttctttatccaatctgccattgatgggcatttaggttgattccatgtctttgctatggtgaatagtgctacaacgaacatatgtgtgcatgtgcctttatggtagaattatttatattcctttgggtatatacccaggaatgggactgctgagttgaatggtagttctgtttttagccttttcagatgtcaccaagctgctttccacaatatttagtcttcttacacccccaacccccttggaagtttagaatggaagcacatttcttcagatgattattaactctttgctttttctgtttttactgcatcatttaaattatggtgtggaacatcgaaaagggccctaaagcctctattgtcaagtatgactgacctctcttggtaaagcgagacctagttctgactgagattcctccagtcgtttcatggttaactttccattcagtttcagttgtatttcattgtgtttcctgcccagtggagattcagcatagatgacacctaaggaaaaatgctagtcatagtgtgagaaatcatagccttctctttcaaatgcttttattcatattcctttggacttgattttagatattgctcgccaaatttagccatctttcttggtagacatttctgaaagtttagtgattaaaagcttagagtctagagttaaatggagtctagagttaaatagtctgggtgtggactctggcctggtcacttgccatctgtgggcaggccacttctttaagcctcaattttctcccctaaaaaatggagggggatgggggccatcatgatacttactttataaagtggttgtgaagattcaaggagaagttgatacatataaagttcttagaacagtgcctggcaggctgtaaacaactataaaaagttaatcattattttcagaaaaaaagttgagtcaaacctgaaacagtggtacaatgtcaagagcaggaactttgccttattaattgtgtcttcctaactctatggacttaggatctgagactctagttcctacaaactcatccatcctggggcctggcatatgggagctataaaccacatcagccctcctttgctctttttccttagggctgccctgaggaagaaagctaatgtgtataacatctagcattatgccaggtatgtggccagagctcaaaaaactatagctattattgtattatatactttgctctattttttatactcctggttaatgacggagagctctgtgaggggctgctagagggaaggttcaattattttagaagctttagttcttccacatttcactttgtaatgtttgccttgccttgtatttattaaacaatagtttactatactcgttcctaaaatattaagtatagcttattatgccctgttaatctttctcagtggcatacaataatttaaatatctgcttgaaaaatctcaccaagcattcattttaatgtggcttagaatgttatataatatgaaaaagtacgtgttctttcagaaattagttccaaagaactccctatatctagagacaggctgtgagaatggagaaagttgaggagtgtctctgttaggaatcttactactgcttttaaatttcatggaacacctattaaattgcttcgcagctaggttatgaggaaggggagccctgctcactcttttaaagttaaaagtgaaaagttacttgcgggtgattagggaaaaccatctcagaggagtggactgttggcatggagaccccacatataactcttgggggatggcaaaaacttgagagaggatgctttatttctcacctcctaaaatgcctttcccagctttctgtggtgagagagaatgagacagcagtcatacctaacagttggtgaaacagttctatgggagtgagggaaagtgaggggcctaggatgagtcagaaacatgtacatacggaaagggagagagacaatcctgattaaattgtgccttcttgcaaaaatatatatatttccacatttgatacaaagtgaagtatataaccttgacaaagcgatatctgtcagaaaaaaaattagaaaaattgctttaaataaacagtccttcaaaagatgtcaggcacagagactttctgagaaaatgtttccaaacttttaaggaacaaatagtatgttatataaattttctagagtttgtgaaaagaaaatcaacttttcaattcattctatcaagtagacctatttgcaataagaaggaagtccctcaaccaatcttacttttcggtagataaaatcttaaatacaacttggtaaattgaatcttgcattttgttaaaagattcatgctcatgtcaaataaggccgagtctgtaaatgtacatatagttaattttgatcaaatctggtcacagaatccatcatattaatatggtgaaagaaaaagcaatagacttgtattgacaggtgccacagtggcatttgactaaaacttaatatccatttgttgttagttttttttaaaaggatgcagtgaaatagcaacagaagaatatagtgtttatttcaatggtgaaaccaatttttaagtgtgagtcgtttctattaaagtcagcttagttataagcaataagacgtaacataatatttgtatgtaatatttgtttgggaagttgtatagttattgtcaagttattgttctagtacaacaacttgaaacataaaatataaaatgaaaactgactttatagctatgtgggtatttacctggaagagccaaaggaattagttgaaatgttattagaaatgattcagtaattcagataggtagccaaatacaaaattacatataagaaagctattagcttttttatagaaagtaataatcagttagatattataatgaaaaaaataaaatacctctttatttacttactttcttactgttgtccaggctggagtacaatggcacaatctcagctcactgcaaccttcacctcctaggctcaagcaattcttctgcttcagcctcttgagtagctaggtctacagacatccaccaccacccctggacagtttttcaaaaattttttgtagagatggggtcttgctgtgttccctaggctggtctcaaactcctgggctcaagcaatccgcctgtgttgacctctcaaggtgctgggattataggtgtgaaccactgtgcccggccaattctttttaaatagcacaagattctagtcacaaaaacatactacacctatatttatgagtgaaaataataagaaattagaagggtttttttggtattgttgtgaagaaaacaaaaatgtcttaactaatgctaaacaatccacaatattcattccactataggcaattccaatcacattttatttttgattttaataaagtatttcaaaaatcaagctaacatgggaaaatcaagaaaaagttgaaataaagcacagtgggtaaaggttggaaggatgtagaacacaccattccagagattatatcataaaaattacagtaacatatatcatgtaatatataatattgtaagaattaggacggtggctcaaatgaagaattagataaagttgatttggatagactatagatttcaaataagactcatttatgtatttgtgtgtgtgtgtgtgtgtgtgtgactgaagtagcattttattcaatgagaaaagggatgattattcaataaatggtgttgaaagcaacagctatcgtttgggaaaataatataaagttagattctttctttaaaccttatataaaaatatacattggatatatattttattaaatatttatttaaataaagatttcattaatatataatatataattttattaatgtaacaactaaaaagtagtttagttaaaattactaaaataaaataaaaatgagtatttaaatttcaacatagggaggatatttctaagcatatcactagagcgagaaagcatgaagaaaatgtctgatagatgtgtatacattaaggaatcaaatttttctacacatcaaaaacaccataaagaaaacgtaaaggcaaatgaaaagggtgggattctatttccagtgttactaaagagacattgactttaatgtcttaaaaatccttagaaatcgtccaggtggggtggctcacgcctataatcccagcactttgggaggctggggcaggtggatcacgaggtcaggagtttgagaccagcctgaccaacatggtgaaaccccgtctctactaaaaaatacaaaaattagccaggtgtggtggcacgtgcctgtaatcccagctacttaggaggctgagataggagaatctcttgaacctggtaggcggaggttgcagtaagctgagtcatgccactgcacttcagcctgggcgacagagtgagactctgtctcaaaaaaaaaaaaattcttagaaattaataaggaaaaaaatgacctttcttccaggaaaatgaacacaatccataagaaacacaattggtgagttacatgaataaaaccccaactttaaagaaatacaaattaaacaatagtgaactaacattttctctaaagagtattcaagattaaaaaacaaagtcaaaactagatgataacaaattcagcgtattgactaaagtcaggacattcttattcattagcaatgaaagtgaaagtttgagtagctttctagaagagaattcaagtcacactatgaaccaacaattttactttgaagaatttatcctaagaaaaaaattaagaatatgtgaaaagatttagttacatcaatgtttattatagtggaaaactgaaaatgtgccaagaaaaaaaatgagccaaatattcagcagcgggaattagcacaatataccttgatatgttatcaaggtaaatgtgtatgataggatactgatgcataaggataatttttaacatggtagattttcattatgttaaatgaaaaaataaaaaatacataaaatgagagcccatttttataataaaaaatatatagtcattcaaggaaaacatgtagacggacatcacaaaataccaacaacaggtatggttcaaagtgttataggtggttttcagcacatagattacccctagcaaagagacctctgtgacacttcgtttcttcatctgtgaaataaaggaatcatactagattagttctaaatgcttttagcaaaaatatttcataattctatgagtattgatggttaataaccttgagaaaattgttattatttattgaactttggagttagtagagtaaaaccaagtttatcctgagctatcccttgttttagttaaaattagttaaatttaacatcctgatgtttatttataaattgtgcatgtgtacatgtgtgtgtttgtgtgtatatatatagcgctttctcacaaatgcctgttttgctgtggagtgggttgggtgggtacagagtttcactgaaatgtatattcccctatagaattcttagagacacaaatatatcttgttaataggttatatatattttcatgtttcatctaccatttgaaaccctataaccatttgaaatcattcttggttttggtaggtttctttaattaacattcacattgagaaactataagagattcaacccttgaaaaagtccttttgctaaagagatttgcatgtgctctaaaaattggtggaaaatggttctgctctaatcaaacgaatgtcactctactcttatttctagctaacagtaaaactgcctggaaaatgataacgtacaacaaatatctcaagtggttatttagtaccttgttgtgatagtgaatgaaaaacacactcagttttaatttgctgttgaacacttaacatttcacagtggctggctgtttggaggccatatacaatggtagaaaaagtagctttctaaaagtgctttgcctcattcttgcttaacctggcagacgtcatgaacttccaagagggaacatattttatttgccttataccaccagaggacttggccaattattgctatttatttaatgttggtgttgacatagtgcctttgccctgaggagctccaggtgctttataaaattagtcagcaattcacctcacagcctttacgccagagagtgaacattgaaaataataatgattcgtggaacctacagccacccctaactcctatttctgtttgcccagtgaaacagaacaaatatgcccagttccctcagagagctagcagaaaaaagttctagtggggtgtcatgggagtttctctcttgtgtaactaggtgaactcctgtaaggaaaatttgccatgcaccctgcagagctgagacttactattctctgttgtaggacccatactttccccagtaaggaactccattttttttcaggcctttgctcaaatatcactttcttaataagacctttcatgaccatctgtttttaaaaacaactaatcaaaacctatcctcaagtgcagactttctgtatcctcattcctgcattatttttctctgtagcacatgtagctattcagcacacttagatttttatttatttattaattaagggttgactccatcccaccagatcgtaagctttatgaaggtagaacatttgtctattctgttgagttatgaatctttagaacctaggtgggtgcctggtacctaatgggtgtgaaataagcatttgttgaatgaatgagcgaaggaatgaatgaataaataaattttccccagtggagcaacaagcaacagttggagtcccttgttgtcaatcaaatataaagatagcaaagagtaagtaagcaagagtgaacttgcatcatatcaagatttcttttatattccttaacattgaaaatattcatgtggtgaaatacagtattagagttttctcctttagttgcaaataatagaaactgaatttaagccgacttaaacaaaatagcagtttgcaggatcttgaaactcaaaaattcaaaggatacagctagttttaatggttgtgaggattgctgcaggccctctcatgatttgattgagcgtttgtctctgtctttctctttctctccttctgtctcactgtgtttctaagactttctctatgtggtagcaaagaaagctcagacagcacaaggctgcctgtagtaattcttgtgacatgagagcatacatctcccagtagttccaaggaaaacccagggctgacttgaaacgtgtgcacttggattacaggtcaaccttgagtcaattgtgactgactgaccaggcctctgtgtgtcccggttgtggaggtcagttccatcagtaggagggggattaatcaaaggaaaatcagaattctttatcagaataagaggagaagatgcatgacaagtattcagagatacactgtaaccagaaaaaatggtcatatgtgaagagtatctcattacaacagggaggaatgtagttctaagtcttttaaagttctgctttcctataatatcagatgaccacatatttcacagcataattgtgaaaatgatattttgaaaggaaaaaggaattcttatctgagataaaactgtcaaaaaagtcaaaatttggctgtgaaaaaagtgaacgtttacttgaggttgtcattacttatttccttcttatataattcatataattctatattattatgacattcatataggcaaggtgttaaattctaatttgattttataatttttcaaaagagacttagaatgtgctagaaatcctaaaaatttctgttccaactattggtatttgaattatgtatatactgcccctttttttcctataaaaaactgatagaagttcatagataaataaaattcacagataatgttacaaatttatttcaaatgttacttcttgcctttttctatgccaagatacttaacaaatacttcaaaattgaaagtatttttactccttattttatctattccacagaatagttagaggtagaggaagaattagataatatatttattaataagtcaacatcctattaatggatgaacatagaaccaactcataggcaacacagtcagaaaatcaaggtgtggcttggttggcatgaaagcataatgcccacaagaactactgttgttggttatgctgtactgtatgagaagggcatttctgacgttagctttgatactagccttttagtaactgagtaaagttagtgagtatactcacccagttcagattattaattcagtactaactcagtaatttggtgttactacatactgagatatccagctggattcaggatttgctcaattcaattagcaaatccagtgttaaggggaaaaagaagctttgtgggtaagcatttctaaattggtgtttttatgaagccacaatattctggtagttcgtcttttccttcagttctctgaagttgtaatcatttctaaattgttgctttctaggtaaaagatgtgagataggggaaaggaaggctttcttaggaattttttttctttcattgcccagttaaattggatttgtgatttatatccattcatcctattcatacccatcatatatctgtatacatctgtcatatatccatcctgttcatatccaatccaattcataagacttttccatatttttcgtgagattagatttttttagtgggtgagaagaaataaaaggcacataatattaacatgctcctggcattccagcaacgaataatgccatagcaattttataaagattaaaaataccctagctcactatgattttgatgagcgcaacgcacttttggctttgtgggtcccctcctcataaaaaatacaaaattatattttgtagctgcatttatgtaaagataaatataatctaaactgttttgtactcattttttcagattttaaaagagatttaacatttctatgagctcctaaaattatgagctctaggaatagtgcttactgtgctattggataaactaagctggcattgtcatagctaaattggttacattttaagctgtgaatgaaagggaatttggtaaaccaaacaactgttgtatgcttattgttcattccagtataaatatatttttgctattaacattagttattacaagtggaatacgaaggggtggactcagggtttggaaagagagttaatgcaagtgagtatttgactccatcaacaaaactttacaagtaaaatcctcaggttttgtgcctgtaatctttttacaggatttaatgctattttacttcgtcaacaatttttttttcttcaaagatttgtatttttaaatgactgatgctatgaaagaaaataccctcatgattatatttatattgtgaatttttacagtaggggcaaactagaatttttcatgcggagagcactttgggttttactcaatatagctcttcaaagttcttcaaagttcaaagtaaaaattgatgctagagtaattttcctgtaatctaggtgaaaagcccacatatcatttaacaaagtaaatgctcattcatatttaatacaaactcttttttcttctgttgaagctgacttttatccaatttttagtttccagttatctatggttttgggaaacagagctaatttggattcatgaattctgtaaacaagtatttcttgagaagctcctggttgtgaactacctagaatgaaactgggtaaactaatatcaacatccattcttttgccaaacatcactgataaactgcaacatttttttttttacgtgagtggtcttggaatcagacatttctgcattgaaaacccagcactgttgctgactggctgcatggcctgcatctacttctcacatttctgactgcctaccaggttccaggcactgttctaggcactgaagatgaaaagatgaataatatggagttcccatcttcaaagaagttacaattttaaggaagactggcaaataaaagttaccccacaaaataataaaaatacaggggtaaaactagggcatagttatattttggctggtctctttacctctgaggttcttttgctttttatgtaattggattttaacctcagaagactgtaaggttaaagatgataatgtataaaatcagtactctgagtaatgatcaaaattttctgttgccatccacacatttgagtgagatgtagtgagtgctagaaaataaagcagttcgtatcaaaaagggtgtgttgaaagaaataaactaatccttgagaaacactgtcatgcaatctcatatctagaaattgtgcctatgttctgtctataaattgatgaattggcagggtgttacatttaggacacacattgacactacatatgacatttgtaaaaacacttgctaattcagctaacagctcgcttctccccttctccccactactcactgtggagagagcttccagctaatagcttagaatctcccagactaaccaaccattgatggaaccaggtgctatgtgattgtaggaatttatttgttgctctgaatgttaactaaaagtaatgggcttcttattttgtccttttccttttgtgttatagacggcaaagactgtttctcatcagtctcatatagctaaattagatttatctctcatgctgactgattaaaagggttaaattctgggcacgttgtcccctgagtcctctgaaatccatgtcagaatagaagtgctcattaccagactcgatgaggagctccttttccagaacttctctctgctacactctaaggaccaagcacctctgcctaaattccaagcaaccatggcctgtggcagtcttggaacttttgccctctggcatgggtagaactagcgtcaattgggtaattcaatccctgagttccttcttcaatgaatgagagaatccaggaatgtgttgccagttgccttttccttgtacctagttttccttgctgcagaatgatgacagtctatttccacacctcccctcctgccactacaggatttatggtctgcatgccccagttgtgaagctggcatgtagcattttgttgccacaggcctgtgagtgtttagaagtttgtgtttgtatttccagggctacagtttgaatattgaaggaacaaacagcaaacaattcagaggtcaagctgtgactgcttcctcatttggagagcttattttatgtctgtatattctatactcagattcccacataacttgttttttccaccttcattgctttggttagatgctttcaagtgcattttttctctaagaaatctccatagaagagttgtttacttgaagtgatgggtgagcaaagtttgcctgacgtggaacctcagtaactttcccctaaggaaaagttctggcgtgtaggggtgggcgctcttccatccagacggatgggaacatagccaagcagccaggagacacattgacttgtgaccactgggaaggatgcctagccagaaaagtcccagcagctgggtctgttaatcttttctgaatgaaccagcaggcagttgacctctctaaacctgtcctggattcctttatatctttgtagtcacctttttaccccctcaagaattcccctataaagttgttcttaataagactctttttgcccacttccccctgaccttctgagttgaatatgaatttcactaattggtgaaagaaaccaccatgaccttgataaagccatttctactctggttcctcccttctaagaatttgttcattcaagcaagtatttgagtctaaatggatccacttggacattttaataattatcatgaacctcagtatccttaaagtgtggctaaaacaggctcaaaaaattcagatagtgtaatctactttctctctccctcctccagatttaagtggattaattcacttcactatgccagcacctgagtacagaataatttatttctgtgtcgtttcatgatgaaagtccagctggcattagctcaaattatgcagctggctattaattgaagaaaacttccctgtcactcctcagtcaaacatgatctgattcagcagatccttttcactctcatctcttctattctaccagtagaataaatgtaaataactttcacttggctctgcttgtcatggattgtaaattacctggcagcatgcagactgaccacattactgttttggaggcggcttgtttcagttgattagtatttctagaagagttttgcacatttcatctctgaggcctgaatgatgtccactagcaggaaatattgtagtctgccttttttcttacatactgtatactaaatttcaatctaatttcaacaagatgtcaaattctagcacctgtagggcaggtgttggtcttctatgaattgattatatgtttttctatcatactggatggtgtacaagcccaggttgtattttaaatagaatttcaagagagagatttgttctggaatttagaaatatatattatgtgccaaaattatttgatgagtgcattttgtaattcttaaaatacaaaactacttggcatgaagagatgctatagtatgttaacaattgtggaactttttcataagatgaaattctgtgcagaaatgagggagcagaattcttgtgggagtgctaaaatggttcatcaatttgatcctcacagcatatgagaattcaccaattatattactctctgaaaatatgtttcagtatcaagggcctctttttgcccttcctccatcccaatgtctgtactctctgtacagtgtgatcactgggtgctgcatgaccagtcattattatacgctcagccctgaaaatgaacttaagatggtaaaatcataccttgccaggatttgggtggctgtgagggattcagtaggattttagcaacagggactggaaaagaaatcagaacttggcagagaaaaaaatagcactaggatactagaagagacctgggagaactagcttgaccttagaggctggtcttgtgagtcatttgagaaatagtatcaaaagggcataagagggcccggcatagattaggctatttggggttacaggagatccaaagctagaaggggcaacaaaacattgtggtatgaggccatcctaatttgaacatcaggcacaggatctagtgtccatgaagtagatctcagggaatgggcagcctgagaagaagagtagatcatgcagaagccagcagtcacccctagatccagatctgagtgtcatgacctagatgcaattaaaatccttataatgggtcccaccctggcaggattctttcaggaactcaggctgagcctgaagtgagtagattcagctgaagggaaggtaaagaactataagttgatagacttgcaaaatggagaggctgcttttaggaaaccattgataatagtatcaatcccattgataatatatgtgattgcccttttataaggccatgtgctttctgcacaattatgataaagtatttagccaaacttgtattccctatataaagggggaggagatagtatcccatggggaattccttcccatattataaactggtagacaacttaagcaaaaatgtttttactcatatgaacactgttgaagtataaagccaggtatttaagtcatgataggtgtttatttactttgaacatttgccagaagtttgatgatgggtatatttgtagactgggtgttagaggttgttatattctaaaaagatatcttctgattaattttcttcatttataaaaacaatctattttgataacatttaatttatgaactttggtgtcatgttacactttatacattttggttgtacattccctgtaatgcttacagagacagccagtcaggcaataattgctacatactgagcgccttctattttctgagtactattgtaaattatagagataaagcagtgaaccagacagagtctccatcctaaaagagcctagtagaggatgggaactgatgtagtatcttgtaattgtcacagcatggtacacttgcttcttcagatgccattattaagggcgtcgtttctttaaattctgagatccctaactcagcttatgccagaactgatgagaattagaccttcctaaggtcttctttcttcctaaaatgaatattgaaataaatctataagataaaaataatcctaccaccaagccccaattaagactggatttttaacttgctcttctcagcacaatgacacaacagaggacacagaggttaatggaatgtctttggagcaaaggagatttcaaaaccaccagtttgttagatttgatgatcagctctgcaaaatgtttaaagaagatttcttactcatatcttataagttaagactataaatggtttaaatgggggaggatgtgacaggattgaaaatcttccccttcctttgtggctatgagaattcacactgagcaacagggaagagaaggaactagaacttggaatgagcctgtgtgtgggccctcattgttccaggatttacaaagggctacgctgtcatcatattaaataaatggctcctgctccttgtgccagcttaattgccaccttggctcccgaacaaagaaatcacaattgaggcaaaacatgttttgctattgaaggcaaaacctccttagagcaattttggggttgtttttccatttaattttttaacttgcagaaatagccctctttttttctgttttttggttttttttgttttcgtttttttaaatgatgtacacttgtgctgttaagtttcagcatggaatacaggctttatgtatttaggcagtaatgctgagttagatattggtaccaaaaaaaatgaaagaaagagagcaagaggacagcacatgtcaaaatgcctgatagaactgcatggacagaactaaatgtgcttccctactgttagttacacgtataagtcacatctcaaagcgtgttccccaggttagcatcaatatcacctaggaacttgctggagatgcaaattatctggttccatctcaggcctaatgaatcagaaactctaggtggaagggagcagtccagcaacctgcattttacaaagacctccaggacactctgatgtatgctagagtctgagatccactggtgcaaagaataccataggacagatgtacactaactaaactagttctgtttctcttaaaatgactttgacaatatttagaattttgaagaatggtatagaaattcatagttcgtgtgtgtgtgtttgtgtatgtatgtgtctgtgtgtgtgtgttttagcagaattctattttagaaaatatggggtagacttttatttagttttgttatttttgttatttttgaaaaattaagaggtaagcagagaagtatagccagctacttccataattttgtaggaataatgaagtttattctagcagaaagttatatcttatggaataacttctctaatattctctctagacatatattcttttttgaggcaggaacacaaaagaaaattggcttcttcatcaagttcaaagaaatggtgttttaattatgtagagaagtaatttcattttctcagagaaatgggtagacagatattagtaatttaactctcttcttaagtaatggctgctatagctcttaccaacactgaaagaagtagagtcaaatagatttaaatctggctagtgattagaattttttggggggtagggtgggtgaaactgtattgcagggaggtacgttgtaataagacagctagttattatgcactaccctccagttctttgacatgatagctaagggcatagacaaaaatctgaactctgtggtctttgtacatatctgcattcagattaattcacttaacaaatatttgtggagcacctaccatgggcttatcactataatgggctaaggttgtacagtgagcaagatactcacatatgtgattcttgtgaagccagaggtccagtggtaaagctagatgagtaaacatcaattacaatgaagtataatcacttccaggatgaggcagaatataggatgttatgcaagcagtcatccttgattttaggactgggtgatgtggagttcatgaatggttcatggaagaggcactaaagcctacagtgtgaatagaaattagcaagatgatggacagggcaggcagagacaagagcatatgcaaagttggaaagtggagagttcttgacattaccacattactgaatgtgcatatggtggagtttagggtgcagagaggacagttgcacatgctctggagaatgatgggagatgaagctgagaataatacaaggaagagaaaataacaggccttgctatccatgttaagaattccggacttcattccaacaaaagggaaagtctttgaggttgtagtatttggctgtgctgtagagagtgtattggggaaggacagtgctgaaggaaaggagaccagctgggacattgctgcaataattcagaccggtactcatggcttggaccagcagcaaggggagaatgaaaagtaaagagatttaggaaatagctacttaggaaatagattgaacgggaactggcattcaatatgtgtgacagcgaggaacaggaagacacttgggacaactagaagaacagtaggccattcactgagtttggggtccagcaagaggagtgagtttgagggtgaaattatgtgttccatttgggctagtagggtctgagaagtctgtggttgtccaagtagagatgtccaataaactgtggaaaatgcaatcccttaggcctctttattctcataaatacttctcatgctttttcacagcagaggctaaagccaaaaaacttttacagttgttgattactcccatagtgattgggccactactctcgatgtcagttttaagtgttatgtgaattttagcgttgcagaattttagcattgcagaatttttctgcacaaaatcctagaaagcaacttagtttactcagtgaaacctgcctgccaactaacaagacctattatttttcagttgggattttacttcaacagtggaaactatgacacaacagggatggtctaaccccaatttgagcactctgttctcattttcattaggaatcacttccctgtaatcataaaatggaaatatatttactgtagacatgttgtttggtgaaagcaacactaaaaatgagtagatgaatataacagctacaggataaaataagagttcccatttttaaaaagaaggactatgtttacaacacagctctccttaatgttatagtgttattatagcagtgaattttcaaataaaatatttaaattggaatgttagaagttttcttctatcatatcaaataagtggaaggccacctgtttgatgattacatattcaagtgatagttctcaaaaactaaagaaaaatctcatataaattataaatgattctgcaaagtttcacctaacattttctccatacttatgaagcttctgaagttattttacttttgagaagccacagacagaaaaattaatataaatgagataaatttcaactagccttgagaataaagagagcaaggatagtcatcaacacaattaagaatgaccaaatcctattaatgttttcaaattaccaaattagaaaagttaggaagcatgaataatttatttctgacaacatattctttttaatatctgcattactttggtcggctaaggagataaacctactcatgtgacataccatatgtaaacattttcctaattaataactggaaagcttctatgtgaaatacaaactttctgctcatacataatgtagactacaggcagacagttaagagttggtcaaagctgtcaaagcttgttttatggaaatctcatcttcttttcctgtgctctttatcctagtccaggtcctctgaattcttttactctacagtacttagctaatacagtgtttatcctcacattctatcatagcttttatattaaccactcagcaaaatatgtgtgcatgcacatacacgcacaaccatacctatatttaatcatctagtaaactatattaaatcttctgtaaacttcagataagcctgtttaaattgggggtgggtcgtattgtagcataccaaatggttcatataccaagtatatatttgtcatactatgtggaacagtattatatttaaaactgaagtcttatttcatgtaggttgtaccaaatttgtggtggtaaacattgtatttaggtcattcacaaagagtacagaaatacagattagccatatttttctatagtgccattcagtgtaataggtacacaatacatctcatattaaagaaaaaagagtcttttcaaaagcctgtaagggtctgaataaaggtcttagaaatgtgtcataacagctgaaatctaagagatttggaaaaagtgggagaagttaaatattgcaaatgcatagagctaagacttcttcattgaaagttgggtagttccaacattcatgtggaaaatctttaaaagtagccaaaaggtaattttttttttttttttttttttttttttttttgaggctgagtcttgctctgttgcccaggctggagtgcagtggcatgatctcggctcactgcaagctccgcctcccgggttcacgccattctcttgcctcagcctcccgagtagctgggactacaggtgcctgccaccacgcctggctaattttttgtatttttagtagagacagggtttcatcgtgttagccaggatggtctcaatctcctgaccttgtgattcacccatctcggcctcccaaagtgctgggattacaggcgtgagccaccatgcctggcccaaaagctaattttttaaattttccagatagaacttcatgtgtatttgatatattccattttcgtgtatccaatattaccaaatccatggtatttttattctttgttttagatattctaatcatttcacagcactttcattacacatctgcccagatttcctgttgctaaatttcagacactattctttaagtcttggaagagatcaactttttcagcacaacccatcccaaacaatgtaatgttactgtgctatattaagacaacacatgtgctgatctttttcaggcatttccagaatttttattgaatgtcaagtatgtgcaaggcaaagtccatctagcgattttaggatttccaggacctgccatttataaacttcctggaagaaaaattaaccccctcaaaatgggtgttgacatccagtttgcctttatagctcctctgatgccttttaaaaactatatttacccatcttatgtcaataaaaaggatgtatttattataagttgtggcagatagtgttttatagacaattttatagcccacgtgttaaaggtaaaagcaaagaaattatgctactttgctgtattttcccagtgatttatgtaagtatttattccctgtaggaaaaagttgaaacactattgttgacaacagggcccaaataggtatcagcttgatgtactttatcacatattatctttttgtttttgcatcatccctaggaggtaaatatgtaacactttggtttcattagcatcacaacagattattaggcaaatcaacagaatgaaattaaagttatattatctaattgaaaaaagccttcacttatattttcaagcattagttcttatccactttcaatcacctggggaactttaaaaaatctgatgcctgggccagacacccagaaaaatgacatcagactttctggggacaggacccaggtgactgtatttttctaaatgtctttcatgactccgctgctttagaggttcacagacttccacttaaagaactgctggttaagaaatgcatccctacttgctcggactcccagggatatcacttttcacctgttcctatcatttagaaaaaaatgatttgaatcagctagatacatgatagaggaccccccccccacacacacacacacaccaatctaagcacaaaattatcttgttgtcctcaatagtttgcatggataagtaatgcagaataagcatcatacccaatattaataaatacttaacaagaagcccaagattttaccttgtttcctattttttccttcagccatcacattcaaacctggcccaaaggtttctcacattctggcctccatcaccaccactactgctttggcctggccttttgtcaagctagaaattgccagaatttcctgacaacaggctctgtaagattcagtttagagcttacactttggctggagttcatcttcctaaaaagagactgtgatatgtaaatccacaacctgaaatctcattggctctccattgcctaccaataacccaaaatcctctactcaggaagtcctggatggtgtaactccattgcacacaggttcatcccacaaggcctcttggtaatggggtactttcatgtgcatactattctgctgctcttgtggaaagagtcttcaaccccattctgtataccctggacactcacctgagacccagctgaaacagaccttgtcatctcggaccctgcccttggttctgttgaaagaattagccaccagatccttgaggctgtctcaggacttttgcttcacctttattataacaattggaatgcaggcaaaatagtgtttccagttactaaaataaaactatagaccatacaatatgtttgttttgtgcttatttaactcgcaggggaaaatacccatatttttaagactctggatttaaaaaatctggttgattatatgagaatattgttggcttgtctgtttgattttgctttttttgggttgccaataaaattttagagcaagaaaatcaatctctggaaaatatgtctaaaatgcaagagaaaattccaagaaaataagctagatttcaattaacatgtgaaaagcatttcttaatatatacaatgtttattttacatggataatttatgtaagttattgaataaataatacttttaggtttgggttttaggggaggttttaggtttgggttgcagcagaggctttttcagctgattcaaatatctagttttcaaaatactctgcccacatgatttttagatatgacttagccttaattgctgactcagattttcaccttttaaaaagcaattgtgctttttcatatacactatcaaacaagattataagatattttaaggtaagaaagtaaaagggcatccactaatgatcatcagaatcacctggaagggccaataagccacacattaccaggccccttccccaaaatttctaattctgtagatctgtggtacagcctccaattttttgcttctaataagaccccaagtgacactaatgctgctagtctggagaccacactttgagaatcactgcattaaattaacaattttattggttgagttttcaccacagtgtgcatatctgttgactaacaatgaatagctttgttgtcgccaaacactgtaatgtttccaaatatccatatgtagtcacaggcccagagaaacaaaccacatctatattaagactgttttgttgttgtttgacccccccaccctttagtgttttaattacatcaatcctggagaaaaataactgttttctaatttgggcattacagatttgctaaggcaatagaaaattctatcttaaacctttagatttttagtcttctagtaaatataagcatatgagttccaagcaaattctgagttttaaaaaatttaataaaattgacaaatgttttcaataaaattggagaggcccatttccttgtacaaatattctaaaaatagatgataaaagttctaagtgccattttttgaaagatcagcaaaataattctacaagtatttgtgggcatgttatcttttctatgatactggttataaacttaagttatatgaagacagtgtgttagttaaattatgttctagtcctaccttaaggaaataaaaacaataaggctcttagggcctttcttctgcaccactgcagtacttgctaacatgttttaataacatgtagctgagaatgataaactctaggcagcagggtggcttggagatactaatggaaatgcccagtcaaaaagagcctggactagactgaggtctgaagactccaaataactttctgttatcccaccatcttctcagatggtccaatcatgctacactcagtctagggcaatgaccctgaggaatggtatgtttggcaaaaaagaaaccaaagaaggctactgccatgctttaagattttcccatatatctttttcagcatcttgaatggggtttctgaaagtctgaggagtgaactgtgaccaaaatggctgatattttgagctcaaagaaacttaaatttttaggtaaggatactaagaccgacttaaaaagtatagtatcaataatttacatttctttagctaagaattttcagaccacttcagtgcagatcacattgactgattctctaaaccactctatgaagtgggcaaagtgatggtctcatttttcaaatgaggactaaggtttatttaattcaagtgattaactcttcaaacatctagtagaggctagccagatgcattggctcacatctgtaatctcaacactttgggaggctgaggcaggcagatcccctgaggtcaggagttcaagaccagcctggccaacatggtgaaaacccatctctactaaaaatacagaaattagctgggcatggtggtggcaggtgcctgtaatcccagctactcaggaggctgaggcaggagaatggcttgaacccaggaggcagaggttacagtgtgctgagataacgccacggcactctagcctgggtgagagtgatattccatctcaaaaatcaaaacaaaaaaatctagtaagggtctatgtctagcgcctgcacttcaaatatgtgtttgtcatgacatcattagcccaatccaattttctttcattaattttctgaaataaatattttttgagtttatactatataccaggtgctgctgtaagtgctaggaatataacagtgaatcaaacaaataaaaatctgtgaccttttggagcttacattccaatgaatataggcaaaataatagcccctgcaaagagctccactgcctaatccctggactaaatgaacattacctcacatgcaaaaaaagattttgcagatttgattaggggcacagaccttgagatgtagtgtccgtattagcccagtgggcccaatctaatcacacaagtccttctaagcaaagacttttccctggttaggttagagagagatgtgataacagaaaaagggtcagacagatgcaactttgttggctttggaaatgaaagaagggggcctggagccaaggaatgtggacagctagaaagggcaaggaagcagattctcccttagcccactcagaaaggaatgcaaccctgaagacaccttgattttagcccattgaggcctgtgttggacttctgacctacagaactataaaatgatacattttaattgttaaatcactaagtttctgataatttgttacaccagcagcagaaaactacagaaaagatagacaatattcaagaaaaataagtaaaaaatatatgttggatagtgataagtgctaaggaaaaaagtcagggaatgacataggaagttatcagtagggatgcaattttgaatagggtagccctccaggttaacatttgcatagactcaaaggagatgaagggcaagaacatttcagatgaaggaaacaggaggctaaaagctgagactaggacaatgatcagcctgactagattctgaatatcaccattaaaagagcagtttctacttcagaatatatgtacaagcttcacctgggaaccatgtgtgatgatttaggatgaagtttcaaaactccacagatgacattcttatttttctataagcaaacagtcttgcccaaataacatcatttactttttcatgtttgctggagagttcattaagaaattcaatacaccgtattcaaagaagatgaattcttacaatcacttagaatttggtctaaggcaaacaattgaggatgttcagactgagtctttttggaccatctactcaacatcattatcaaccaacagcttataccccttcaaagggatctcaaattatatttgatcctgagttgttgctataataaatttagagctggagaaaaatagtcattgtaattattttgttattagagaccggcttacatatgctaaataaataaaaacaaaatgagagttaattctatgtgaaattcaccatcaattttgatgaaatttcctattgatacttccaagtacagtaggcctttcgtatccatgggttccacatctgtgtattcaatccaatttttttttttaataatatggttgtgtatatactgaacatgtacagacttttcttgtcattccctaaacagtacagcataataactattgacataacatttacattgtattaggtataagtaatctggagatgctttaaagtatattgatgtgtgtaggttatatacaaatactatgtcattttatataaggaacttgagcatccatggattttggtatctgcctgaagacctggaaccaatccccaaagatcctgagggaccactgtaatctaattgaggccaagtttcatgggtttgtatcctcttaagtacctgggggaaaaaactgtctgatttttttttaagttttagtataccatatattttaattttcaaagaaaggaaaacagaaattttatgatctgtgtcaatagaagtgttaatatataaagcaaagaaatgcctaggtgaatattggcctagtaataaacattctgcaatggtgcttcatgggaaatacgccttaccttgctactcaaaatgtgatccatgaaccagcagtatgaatatcacctggacttggtagaaattcttggaccccaccctgacctagtgggtaaccatctgcattgcagtaagatcccaggtgattcatatgtgttttcaatgtgagaagcacagcactggggccttacccggggccctccttaggaaacacaccaagtattgcatgttttttacatcctgacaggtccatatgaactcacatttttccgaatacagtgcactagcatatctatcatattttgaaaagctattttcatcaagggagcttagtatctggtgctcacgagatacctacagagaagtagacagtgttatgcttttgagaatttatcaaaccttttggtcatataatgtttttatttcaaaaccttaaattggtcaacatatttttaaatatttaatagttgagggatgaagaggatagaagtttaattagttcaaaggaaggtaaattgggaaggaaacaaacttttttgttgaatcagaattttcaggatgaaaaaagacaccagtgccctgtggttcagtgctaacacagctatgatgtgactcttcaaaggtcaatgcttgtgcccctattgctgcacatccttctccttgtcagtgttgatgtgtcattggctggctctgtgtcattggcttggtcttgctttcactgaactttggcctccgtgaaacttctaagtagcattgctcctacctgtgaatcttggaaacacacagggcaagtgaaattccattttcttcctttctttctttttttaatgattaatagacaatttatttaagcaagatccttatagtcatcattgccagacttaatatgagatgttaaatgttccatccaattttccttcctggataagtttttctttcctatccctgtcagttttgaaaacataataccagaagaagaggggcccaattccacacagagctcccaagagtgagttttaggagtgagtctgaaattagaatagacatttgctgatcttgcataggtccaacgaattaaggcaagatcttcgatgagcccttggtggttagagttggttgttgtactgaagcaggtactcttgtttcagctgggctcttatggccaaccgttcagcttgcatctgccagccttccagagatatgtcatatttggctgagtcgagggtcaagggcagagtggccaggtgcgatggagtaaactttgggaatgacattttggtgacccagcacacaactgcctgaaattccattttcatgtgacacttttgtatctgtaaccatcaggtctgttccctatgttttctattccttaacttggctaccattataccatcacatctctttccttttctagtgactccccattagactagctcctatctcataacctccttttgtaatttaatggcccaaagattagcaaattccagaaattcctaaagtaatccaattagctcagaacatcatagagacttttttttttctttgcctcatcctggggttatttatcaatgaaagtgactttagattagatagacactggctgccacatcgtatcgttgtgacatcctgcacttaactaaaagggcttgacttaggcaccatctccttctctcttggcagctgctcagttagatgtttttgttttaaccaaagggcaggacttcaaatgtgaccctatttaactccatctggttatattttgaccttatgctctttttatatcctgattctgtcatccattctcttagctgtccttcccagcttgatgtaatagtattttcccaaactacacccttttccataataaagattgtcactcctccctcaagcttccttaagcaagctttatcatatgtctgataggatctctgtttctgattgtactcagtatagatttgtttcctggcacacatgtatgcactatgtcacttaatcacagtgcccctattagattacaaactcctgtcaccaagggttttgttccctcttttcaaagcagaacttaaaagaattttgcttacctttaagcgtgcagttcacatcattgactttaactggatggtggttgatggctgatggtcaactaacaaaaaaggagttgaggagttgaggtttcagatataacagaaggatacttaagacttttaaggaataaaaaactaatttttcttagcacaatggttcagatgaaagtaagggtgcatcagagaaggctgtcattggtttatttgttatattcctagctcatggtgattgtatgttagccaaatatcttgcatttgattttaaaacaaatcagaagtagatgactcagaaatgttgacaataaaattatggacaagccccttgctacagcagctcttattaattaaatatctgagacagcagaattaaaagagaagaaagtgatatacaatttggaaggtttggaaagctggccataaaattatttctttcagctggagataccttacctacttataatatataaaatttttgaagaaataagaataggtcttattttactttgcagtgaaggcttgaaatatttgaaagttcactttattgcaataggattaagtacatcaaacttcatccattcttatctctctcaaatattaggagtataactttcaactgaacttctttgcctgctgtaatatactgttctatagtgatattttaaaatgaatactttgtgaacatagtactagaaaaaggatagtgttttgaatattttaatagccttacagggttaaaaaaggatcttataaaaagtatgtttagtaccattcaatttttacaaatttatgcatttgcttattcatatatgtaaatttaaaatttacatataagcttatactcagaaaaagataaatgttgtaaacacacttgcatgcacacacacaccataacaaccaccatgccattcagtggttatttcagggtaagtaggattgcagaaacttttacatattcacgttttgcctatattttctgttataagcttttattttggcatgagaagaaaaaaattttaaaatttcccaaaaacattctttgtaatagtcaaaaattaaaatgaacagtgtctatcaataggagaatggctacaccaacaaaaaaagtcaagtaagaaataaaattggccaggcctggtggctcatgcctgtaatcccagcactttgggaggccaaggctggtggattgcttgagcccaggagtttgagaccagcctgggcaatatggcaaaacaccatatgtacaaaaaatacaaaaaaaatagccaagcatggtggcatgcacatgtagtcctagctactagggtggctgaggtgggaggattgcttgagcctgagaggcagaggttgctgtgagccgagatcacgccactgcattctagccagggagatagaacaagaccctgtctcaaaaaaataaaattaagcaatgggaaaagattcctcttgctattttaaatgttgatcaacattcaaattttcagtggttttaggtaacaagacatgtcaacctcctgaaacagtaattgttgtagataataagaatatatatgagtttggctttacctgattttaaaagtggagagaaaagctgaattgaagcaagcatacaattattttctaaacatatcctctccagtttcagtgttttttaatcaaaccaccaggaatggtgcagcagacaatgccagtccatgtctcccccttcatggtcccttagttgtcattaatgggtgactgcagagaaccataggcatttgaggacttaacagagatatgttttatattgagagtggacataagctcctcattgcctcattgtggtttgcacttcaaactgcagcgtgtactttttctaagctctgtggtctgccttcctaggactgcttgccctgtactgttatttcagaatgtttatctagtgaggagtgctgcattgctccattgtgcatcacagggcacaggaagcaatggtatgacatttttgctgcacatctatttttgattattctcaaaagatgaaaatgtttatcactgcaggggtgtattagtccattttcatgctgctataaagaactacttgagatatggtaatttataaaggaaacaggtttcattgactcacagttctgcatgactggaaaggcttcaggaaacttaaaatcatggtggaatgggaaacaaacacgttcttattcacatggcggcaggggagggaagtgcagaggaaagggggaaaaagccccttatagaactatcagatctcctgagaagtcactcactatcatgagaacagcagggggatctgctcccatgatctaatcacctcccatgaggttccctcccccaaaacatggggattacaatttggattacaattcgagatttgggtgaggacacagagccagaccatatcattccaccttttgccctccaaaatctcatctttctcacatttcaaaacacaattatgccttcccaagagtctcccaaagtcttgactcatttcagcgttaactcaatagtccaagtccaaagtctcgactgagacaaggcaagtcccttctgtctatgagcctgtaaaagcaaaagcaagttaattacttcctagatacagtggaggcacaggtattgggtaaatacactcattccaaatgggagaaattgtccagaacaaaggggcaacaggccccatgcaagtccaaaatccaatagggcagtcattaaacattaaagttccaaaatgatctcctttgactccatgtcttacatccagttcatgctgttgcaagagttgggtccccaccactttggcagctccacccctgtggtttttcagggtacagtcccctcctggctgctttcatgggctggcattgagtgtctgcagcttttccaggtgcgcagtgcaagctgttggtggagctaccattctggggtctggaggatggttgccctcttctcacagctccactatgcagtgccccagtgggaattctgtgtgggagcttgcaccccacattttcctactgcactgccccagcagaggttctccacgagggccccgtccctgcagcaggctcttgcctggacatccaggcatttccatacatcctctgaaatctaggtggaggttcccaaacctcagttcttgacttctgtgcacctgcaggcccaacaccacgtgtaagctgctaagccttgaggcttggaccttctgaagcaatggcctgagctgtatgttggccccttttagccatggttgggactgaagcagctgggatgcagggttgcacagagcagggggaccctaggcccaccccacaaaataaagtctttcctcctaggcctccaggcctgtaataggaggggctgctgtgaagtcgtctaacaggctctagagacattttcctcattgtcttggtgattaacatttggcatctcattacttatgcaaatttctgcagctggctggaattttcccccagaaaatgggtttttctttgctattacatcatcaggctgcaaatttctcaaacttttatggtgtgcttccttttgaattttcttccaccagatactctaaatcatctctctaattcacagttccacagatctctacggcagggacaaaatgccaccagcctctttgctaaagcatagcaagagtgacctttactccagtttctaacaagttcctcatctccatctcagaccaactcagcctggacgtcattgttcgtatcactataagcattttggtcaaagccattcaacaagtttctcagacgtcccaaactttcccacatctttctgtcttctgagccctccaagtctctaggaagttgcacattttcccacattttcctgtcttcttctgaggcctccaaactgttccaacctctgcctgttacccagttccaaagtcgcttccacattttcaggtatctgcagtagtgccacactactctcagtaccaactgactgtactaatctgttctcacactgctataaagaactgcctgagactgggtaatttgtaaaggaaacgggtttaattgacttacagttccacatgactggggaggcttcaggaaacttacaaacatggtggaaggggaagcaaacatgttcttcttcacatggcagcaggagagagaagtgcagagtggaggggaaaaagccccttataaaaccattagagctccagagaagtcactcactattattagaacagcatgggggaatctgttccatgatctaatcacctcccatgaggactttcccccaaaacgtggggattacaatttgcattacaattcaagttgagatttggttgaggacacagaaccagaccatatcaaagagtttgctttgacaaaaggaagtgtatctttttatttacttatttacaaagcagcttattaaagttattaaatagttttcaaaggggcagcttttttttctactttctgtattagtaagcaaccatctatgattgtaatacaactgaggtctcccaagagagaatgtagcacaaaacaaggtgtgctatctaaacctgtaagaaatgttgtgcagtgaaccaactccagcacagatatggagctctctcagaaacaacataggaaatttagatatgtgaaattcaaatagaaatagaaaactcaatttagagtttagtttgcgtaatatcttagaaatgttttcatggttcaaagctgatatttgacaattgtgttagatctataaaaattcacaaaacatccctataattttcagatacaaaatgctaataaggattttaaagttcaatgtggaccacagggcttctgcttttgcaggtgtaccttcatttacatcctttcagttgaggaagggtgggtgtttgagagcaaaatgtatgtataaggtaagaagaaaagagaaatgagagagagaagcagaagatagtgagccatcaataatgatattagttggcattcatttcaaaagccaaccaccccaatttagaggatttgcatttaggactaattaaattataagctaattgagcagggactgagttaagcctactgatagtgcttcataaatattcatattaacaataatacaagatgttccttttcaaggctaaaaactttttctaaatggtgtatacaacttgtgagtcttggtaagtcaatgttgttgcattcctgaatttttctatcccttttaaggataattctaactcaagtgaaccgaaattttccctgtagcagtagaggtcctctgaaaattgaggaagctctccatgtgtaatgctctgaaaatggcagacatttcagagtcacattctgtatatcattcatgtgaaatggcataggcaattttactcctcaagattctttgcccagaattcgcaatttaataagaacaagtattatgaattgttgaagattcttccagctctcttggaaataaagggtcttctcaaattgtagctttggtacattaatagttactctgggggcctaaatgagttagttaatgtgcagcttaaacatctgaggcacacccagaagtaactcaggactgaggaattcaccttcccttgctactcaattgccgtttgtgtaaaatagtggacagtgacactgtttgtgtgcagctagcaactgtctctaagtcttgggtttgttggagcataaagtgcactccagtgccctgagtatacctgtaagggtatttaccatgattcataagacttgttttaaaattcctctccaaataaacaccctcttaaatttaattttcctcatatttctatgtggttatttatagttcaagaacaagtatttaaaatatttaaatgatagccattcaattaactattccaaattttagtttttttcaccaaggagctgagctgattatcaaatatgctttatgtgaactctgttttgtttaaagtgtactgtattttttaaatttgtgaacatgggaaattatacaatgttctataataatttcaaacctgagttttttttaaatctcaatgaaagctgtaccttatctgaaatgtaaattagtgtaaaaaccctttcattctcaataattgtcggctactatctttttatcttcatgttcatcaatagtaaacattcaaccttcaacggttaacaaatattaagtgtttaccatgtaccagacacttttctacattctggggtgacagatctagaattacaagtgtatcaaatattataacagacaggtggaaggtgctacaggatcaaataagaagaggacataaacttaactgtagagatgggttggggagggaggaagaagttagtgttagaacaggcaacttttaaagaattaaccaggaagttatgcaatttggggtaaagtggggaaagagtgtcaggaaatgaggttgaaacagataatataagatttgctatttattcaaaaatagtttagaggccagtaattggctgggagaagaatggtgcacagatgggcaagtgttgacctgcaaggccaattagaaagctgtgtctataagtaaaggcaagagatgaggatgacctggattaggaaacaaaaaaatcctctcttttacctgcaaaaatagctgttgactttgtctcccttccatacaagacttggggtctccacgtttccagcaagagactgggcagttatacatctgtttttatttttactctgacctgactgctttatgcaagatgggccaagtctcccttatacatcaggaatgcactgatgtaaagacaagatatctgctcctccagccacctttcttccaggtctatctgccttaattcctcttcccccattctcagtggtgcatcattctctactgctgtcctagtcctgcctcagttttccattagttttattttgcagcagagattttttttttttttagtgatctcctattgttccttaatcacccttgaaatatacctaattaacccaagtaaaccttcatgatgcatgtctcttcatcctaggagtataaatgatccttgtatatctataggaacgtttctattccagtctttgaaattgaggaatttcatatacattatatatatatacacacatacagacacacacacacaacgtgtatatatgtgtatatatgtgtatatatgtatatgtgtgtgtgtatgtgtgcatatacatattccattagttatgaacagctcttttttatctcttaaaagcagcaaaataaaatattgacattattcagtgaattgatagttgaaatgtaaggatttcagaatgaaagttatgtagtaaatcctagccctttccgaatcctgatttcctaaatctaacctatatggaatttcttttttttttaataaaggttccatgaaacttggcctctttcctatcatcttaaatcgttctcctcttatacttctcttagttctacttctttcacgtgaaatccattctaatgtgaacctcggtttctctgagaggtgcctcaccacaatgcccatgcctttctgcacttcccacgtagatcttcttgccccaaatacctactgtgagccttctttcctctgtgcctttcattattccactcatctgaaattcagtcgcaccaactttttaagcacctttatcaggcactgtggtcagtaaggtttacagatgaataaggcatgattgccagtcactgacaacaaatttggggcagggagaacagccccatccccataaatggtctcatgtttcttttgtttgtttgtttgttttgatagaatctcactctgttgcccaggctggagtgcagtggtgtgatcttggctcaccataacctctgcctcccaggttcaagcaattctcctgccttagccttcgaagtagctgggactacaggtgctggccaccacacccagctaatttttttgtattatgagtagagatgaggtttaccatgttggccaggctggtctcaaactcctgacctcaagtgatccccccacctcagcctccaaaaaagctgggattacaggtgtgaggtaccgtgtcctgcccataaacagcctcatttataaaccataaatacataagtgctgagatagagatttgtgtgtgtgtgtgtgtatttggggggtggtggatacactttgcccaacaaatccaatattgtttactacttcctgtgcttcccacatgactgttctctcatctttctcttaaattaatggaaataccctcctaaccagttttccgactggtgcttttgcccatccagtctaatctcatagcagagttattctacaaaaacagtaattagttcacatcgtgttgctctctgctcaaagccatccaatggcatgccatctagagtcaaagtcaaattcttgctatgtctgttaaacttctacatgatctatgtctaccgcccctttcaagtgacctggatctgacatcttctcaaaccactgtccgcctcacccactcacttctccactctgacttcactggtgttccctgaatgtgccaagcatgttctgcatcacagcctttgcactacctgttcccagtgctgggaattctcttcctctaagtatctggatggctggttccatcctgcccttcagatcatcgctcatatgttactttagcagtaatcctttcctattcatgctttttcttccaccttgacgttccctgctgtatttttattcatagcacctatgacctactgtatcctttgttatctgtttattgactgctttcatccaacaagaatgtaagctctataagggcaagggcttttttctgttttttcactgttgtatcctctgtgcctagaatggtacctgtcacataataggtgctcaatgaatatttgctaaaggatggaaggaagaagggaagaggaggaaggagggagagagagaaagaggaaagttgaaagaagaaaggaagggaagaaagatggtagggaagaaggaaggacagcagaaagtctcatgttggctttactaagtctctaacacttattaacacctgctttgtcttataaacagagataacaccggcctgtagcctagtgcctttcgaaggcaacattatctggatagaaactaataaggttgttctgtttatgctgcatttatggcaagagttactgactttccatttatagttgtgatataaagtttcttctttaaatgaagacattttatttcagtttttaaaaaactagtctattacagaatttttaaaattaataatagtatataggggatgcagaaacaacaaaaatcatgatgtagaaatgtggatatggcagaatcatgaagctggtagtcgaatgcctgaattggggataagtgaccccttcagccatgaaacattccctgactattgccatcttcccctctttcattcctgttgtttattcgactcctgtacactatcatgggttgaactgaaaccatttggtattgctcactgttgttttgggtgttttagttctatcttcctaaattgatataagatccttgatgtgagtgctcatgtcctgcccccctcctcctgggcagccaccatagtgcacagcccagcactgacaaaacagaacattaaggatgtttgcttgttgtattcatcatgactcagctacacaataagacatgaggttaaatagtgtgcagacagtaaaaatactcgagcgtgctttatttttttttttagcaaaagaaatacaatagcaaacatcattttgccttgcaaactggcaaaatgaaatcactatttttgccactggtgtaaattttatacacacacacacacacacacacacacacaaacacacaagtacatacatatatacttattcaatctggtaggataaattaatcactaggacaaaaccatgagttaataggagccaaattccagcacatccaattggaatgcttgagaattaaacctgctaaaaatactgactggaataggaagacattcataaaacgattaggcacattttagtggaagtcagcaacaacaaataattaattgatttaactaataaatttagatatttaaattgtcaaggaattctttgttcttctgttttataaatggtattagcattatcttttttactggaaactttaaaggtgtaaaatactgtcaagagcaaaagcaacttagattgcctgtaatgaccattacattgacaccattttttgcagtatgatttgctattaaatgtgaataacgtgaagaacaataacactcctagatcacctgctatgaaccaggcactgctctaaatagctcaggtattttaactcatgtaactgctacaaccctatgaaatatatcctcctttcagcttcattttactagtgaggaaaccaaagctcaatgaggctctgttaagttaccccaggtcacacagctagtaagtgtctgagctgggtgttagtgcacagtgatctagcacccaagtccatatacttaaacactacctttgaatgctgctctgtaccctatataaggaagctgtggcccaaataggcaaacctgtgacaaacgaatcctagagtctaaaacaaaggttgaaaggtgactgtaaaagtaggcatttgatctttaaaaaccaggtgaatttgacctgccattcttgacggcattagtaaacattacatttcttataatttacattaaaaatctaatacttcgtttacaaaaaaagactttcaaagaatatgcatgcattttatgcaaggttaaagaagttttcagtgctggctagtgaaatgggggttagatgccctgtctatactacatgtttaatcaatgtaatcttaaaatgagatgaccttgtagccaagcattttttctttcctttataagcaatattaactatattaaatcaagaaagctaatagtttttcgtatttctcaataaccattaagttcaaacattggaagagtttaatattttacatgaaaaatccacaggcaataattttaagtgacttagaaaatatttaccgtattttaaccttaaatgactgtgtatgtgtgtgtgtgtgcctatgtgtgtgcctatgtatgtgtatgtatgtttataatctagtagttctcaaggagtattggagaaagaatatgtgatcacatgtagtttataaaagctctcgtgttttttgaaagacaaattttttgtcaatctagtggtaacatgatactaattttttaattaattttaatttccctgataatacatttaagccttaaaaatattgttagtgattcatgtttctttttctataaaaattatttctaagccttcctcaaatttcttccagactcttttttctgattgatttttaagaattttaaaaatattctgcaatttctcttgatcacaacaagtgttggaaatatcttctcccgaagaaaagaatgattcttaaaaaaatactttagtagcagtttttttctatgaaaaaattagaagtagctttttcttggcagcgttttcttctagagcaatagggaggaaaacagaaagctgtagactgttatcttcgtccatacatatgttagtgctggaactcaactccaaaaactttgttcctttgaaaatcatatccctccagaattggtggagtggtgatggtgtggtgttgaaggcctattgccaggactgagaaggaaaagctaaagaaagagggaaaaaaaatccagagaaagtgactgcctggggaggagggataggcaagagaccaaacatcgattctaaagggaatcttgcaaatgctctggcaagtctatgtatgggaacatcatttgcctagaagatgctcccctttactccctttttccctattgggctggtttagaggtcaataaacttaattattttacatctagtaatgtcccagatgatataaaatgtcattgttttcattctatcatatagttcatgaatcacagttaaaataatgtttcccttctaaaaatttttcaagttttttatttcaccgtaaagttcttttacatatggaattgaattctgtgtgcagtgtgagaagaaatccacttttgtatgtttcccatatggctaactagttatttccacaccatcgattgactgatccatcatttttccactgactggtagtgttacctttgacacgcatcagtacagttggtctgctttacctttctagctataattgtggcgtatccctctattaattgcctcctttagtgttattcagtgcattttatacattttgttacgaagatcttatacattttttattcacatccactgtagacttctgttgctattacaaaatggcaacaattttcagttatattttccaaatgcttgctgcagctatatccaaatctaataatttttatatcgaacaaatatttagaaacttttcaaactttgatgtacttttaatgatgtttcttctgattcttttaggtattctttgtagacaatcgtatcatctgtgaataacaaaaatttgtttcttccattccaatttttatactctatattttataccactttttaaaatgatttattgactggctgcacggatgcttctctgactttaaaatatgaatccctgagggatccttttaaaaggaagatcttggttcagtggtaggtcaggcactgagaacctgcatttctaacaagctcccaggtgacagtgaggacacttgtccaaaaaaagcaatgctttcaaaagactgttaaatagaaatggagagaacaagcattctttacttgtgtctacaattaaagagcatgcttccacatttcaccatcaagattagatatctttgattagttttggtaacttcctcctattccaaatttgccatacatttttatcgtgaatggttgtttagttgaataattttctgtggtttttcccctttaatctcttaacattgtgaattattagaacatctcatgtttaaagcctttcatgccatatgcacacaaatatacatacacatataggtacatagaaaaatatgtatttattgctgctttatttgctaacatttggtttagactttttaacctgtctttatgattcagattggcttcatgtaatccttgaggattcttaatgtttttaagtttcattatagaatgaattaggtgtataccctcttattctaagctctttacatggaactcacttttatactagtttttgagacacactctgttataatcagcatcttactgatgaagaaacagaggtacatggaggttaaataactagcccaaagtcacatagctagtaagtgataaaattcgttggtttttgtctgttgaacaatgaagagaatggtttcctaaaatttgttttgtttagtcactgattcactagttcaatcttaaatgtaattcagtagttcagtcctagaaacagttttcaaagccactaaaaacagatttagatcctagtgaggtaaaaataaataaataaataaaatgattttgaggccactgagaaaagtggggcccctagtaatttgtaacagcctcccactccctatcaagaggaggtggtagaccgagattctaaattgaaaaatgaaggccgggtgcggtggctcacgcctgtaatcccagtgctttgggaggccgaggcgggtggatcacaaaatcaggagatcgagaccatcctggctaacacggtgaaaccctgtctctactaaaaatacgaaaaattagctgggcgtggtggcgggcgcctgtagtcccagctactcgggaggctgaggcaggagaatggtgtgaacccgggaggcggagcatgcagtgagccgagatcgcaccactgcactccagcctgagcgacagagcaagactctgtctcaaaaaaaaaaaaaaagaaaaatgtaaacacttaccttggctttgtcacttaatggcctatgtcaaaagcttaatttgcttcatgatttcatttaaagtgtatacctttcactgaattctgcagtgatttagcataattcactaataggtatatgcctatcattttcataacctttcaggaaatcatttggccctagtatactgactttcgctctaagttttcctttatacctgaatctcaatctctcttactgagatttaaacctgtatctttacagcgaacttcagaaacatgggaaagactgtcattatccttcatgaaatcctgtggtccacaatgaagcgtgtttattttgttaccactcagtttgatttctttcacattgtttcatggtttttcttaaattcttacttactctttagcatgtggaagtactgcctttcaatgtaagacattttactttaacaattcaaagagatttttttttctatgctacgtagatattagggtacagaagaaaatacaggagacattagcctgctcatgaaggttatgaactgcacaaatcatgtagtcttttacaggtttaattgcctcatttgtgaaaggaggttgaactaggcagtctctcacctctctgtcagctctgatgttaaaggattttgttcatccttacaatgttttctcattaaagctcaaatatgcataattaatgtaatgcattattttttaggagattgaaaacctatcatctagatgatgtgctaacctgatttttgtcaatatcattcttgattctgtttttatatctcaatatgatacagagttgcaaaatatttctaagctttgatcattcttttgggcatattcctgtagataattttgaaatgatatatttagtggagaaaatgtaaaaataatattaaatccttctaagaaaaaacaaatgtattaataattaaatagctgcactgtaaaccaatattcactattcaatcattgattaccaaaaagatagcggcatgaaaaacctctatatttttatctcatggtttaagatgaatattttgcccttcatatttatcattttttaaaaaagaacacatttagactttgaaaacgatatgtaatgtgcttctacattaatgggaaaaacaacctaaactgtatagtcaaataaaatattggaatcttataccttgacatatttttttaaactagacatcatctaatttcttttcaaaaatagaaataactttttatctttgtccttggtattactttatacttgtctgttcagtggcattgctattctgtgataagattttattacagaaaatgtctctatctgtacttgaacattagtctaattttttttacaaatgttccttgatttgacatctgtcaactgatttctgagttaatattatcttttcagtttccattcctttgaaataggaaatccaatattaaacccttcaataaagatgaaccctacatctgtatatccagaattttggtttgataaaaccaaaactgataagttcaatggggttaaacattcttgaagtaaaattggagagacatttgaacacctttaccccaagttcattcatctattcatcttctctttaattaagtctgtttgaaaaaagctttcattgattgttagcttcctggaatatgtcctaaatatcataaggcatatggagctccatgactcctcagaaaagagcacgttgattgatcagtgattctgcattagacatgcgtgctacaagtttgatttgactgacccagagaggaatataaccttaatggaaacagagaaaatatcttcatgtcacttggcttagcctgctcctttcaggggataagttgccacagcattcaaaagggtgtagtctatgaatatttttagaatctctaaagatgaggattttacaacatggtattcaacagcagagtttaatttttcttttttctcacttaacactgagtcattaacagttgagacattttacatgactgtgagcagttgagcacaaaaaccagatgttaagattgggtacagtcaaaagtttagacatccacacctgtgttatgttttgtttatgttctggagcgccaaactttgttacatctttgaacccacttcagacctcaaattaccacattttttaaaagcctcattagaatggtatcatatagtgctgaatccatagaacagaaattcagtgttttcagattgctaatcatgtatgaaagtttctgaaatcatattgtccaacgggctgtaacttggcctattcttctatctcctaaggaaattgaattgactggacactgttcattataaagatacagcaggtacttccttgtaacctgtgctcttctatatattttgaaaattattattcattttcatatttatcaaagtgaaaaaagcaacatagctactctacttatatagctcattttaaggaattttatacttgttttctagttttgtgaatttcttatgaattcacaaaaataatgtaaaagctaatggtctgtccctgctaccattgtgcatattagtcaacaagtacaagtagaatatttaaaagatttattagttcctaattatatatagaaaaagactttgaaaattacttaagccatgattctaccaagatgtaaccacttttattttcttttttccttcccaatgttgactggttatatgcatattaatggagctataataataattgtatactttttatcttactttctaaaccacattattattccttaaatattgctctttcttctgacacagtcttctcatgtatcattttgattactacataatattctgacttaatcgaaactttttgtattttttgatgttcaagcttcttttctcatttgttactattagaaatgatggctctagaaacatccttagaagttttccttatcttttaaattaaactgcttttattttactaaaataatctttaagaactgggattactaggtcaaattctacaatcatatttgtgtcccctgtcattttgtaaccaaaaagatgctatttgagtaagacctgcttgataacttacttattaatcttattttattttgtcttgcatcacaaatgagtcaaattctatttttctctaattaaatcttacgatcaccggtacttggatttaagttttacagtgaaacagaaagaattttaaaaaacggtttaagtaggagaaattatattttcagatctccttgcctatctgctggaatcactagtgccaccacttttcactggtgctccttttgcttcacttaactaaagagttttcactcagacccttatgatttctccaagatgcattacattttcctgctgtttccatatacctgggaaatagttctttcatttacatcttctgtctctatatttttccaggtaagtcatgcctcctttaaatttttactattttttatctatgtctgtctatctctactaagatgttctctacctttgtttctgtctacctaactagctagctacctacctacctatctggaactctacctctgtctcttatactatgcccattcttctcttttctctttaaaatttttttgttgctgttttctcttttcctctatttctgtatctcgtttgtgtcaaattgccagactacttaattagtatattcatgtttgtttttgaatttctattactgtattttctcttattagtatttgtttttataattattattttcctttacttttttgtgtttattttcctattttttctaagtaagttgctttgtgcattgagttttagcctttatttctaatacagtgatttaattctattgctttagtgacaatcccatatatttgatgcataatatatttattattaagttttaagtattttataaatccctttgatttcttctctcactcaagtgttatttagaagtactttttaaatgttttccaaaggaatgagtttttaaataaatacattgttattaatttctaattttgttcatctttaacagaagagatatttgtatagtacctattctttgacattgttgaaactaaactgaaaatattagttaattcatgaacactggattaattataattataatattcaaaaaatataattatattcaaaagtataattatatataagtttatataatttataaagtttataatataaacctatattttatatatttataacttaatataaaattataaagtttataatataattataatattcaaaaatattaatttaggcttcctatttatcctgctttctaatgtttgttttcttttcacgtcttttctggcattattttagatcaaagtgatttcctcccttttctcattgtatttttccttctagtttgtaagttttaaactctaattctattattttaataataaccctaaaaaattttccaaatatgtaacttaaggctgaagttaaataatatctttacccttttactgtcctcctgagaaaatacaaaagaatagatttttgttctcttcatatttgtattacattgtagacattatcattattattatagttgtagtaagtcatctttggtgaacattttctaacacattttccattttctttgctcagcattttttttttttttgcatctgagaccatcctttttatttaaaaatgtcttttagaagtttctctagtgactctccaatagtagggaattctcttcatgtgtggttttcttactatcttattttgtgcttagacttggaaggtagttttgttgtgtatgcattactgggttgacaactacttctcttcacctctttaaatacgatactaccttgtcttttgagaaatcacttttcagtctgaccagtgttacttttttctttttgggtgctttgaaattcttatttttatctttgttgttgtgcaatttcactctaatgaatccagaagttgagtttttcaaaagtttacttaaaatgtattggtattcctaaatatgagtgttggtgtcttttatttattttggaaaattcttagctattattgtttcaaatattgcctcgttgccattccttttaatctatcccaaccctagtaagacttatgttggccccactctgtcattcacctatcttaaccttgctttcatattttccacttctttttctactgcattctgaatgtttcattcatatatgttttctggctcactaattcaaccttcagtagagtctaatttgttgtttcacctgtttgttgagtttctaatttcagttattagacattcaattttagaagttctattggtctttattctaaatatgtgtgttgatttttattgtcttttgctcatttactaaattttttatcatttctttaaacagcttaaatatttttttttattttagttccttgatagttccaatatctgtaatcttgttggtctacctgtgcagtttattccactgattgtctctcaggcaagtttattttttttatgcattttctatatttttttacatatgtgagctcatactctttagtattttatctctggaaattatctgtgttgaaagtgtatttttcgaaagaggatttgcttataatttaagtaactgcatgtctgctaactatagatttactttaaatgaaatgttcaacttttgggccacgcaaatatccaatgccatattacatatcgcaagtatacacttgtgattagaaatttttgaaagaaatatttgttttaaatatgctgcctgaaaccaagacaagtcttgttctgcatgaaagattgtagcatgcctagttataggtattgacttttgggtataagactttctgtgaagtctgaatgtgagttctttctctgtttaggccccttgtttagattcttgccctggaacccaaagaattggtaaatgccttcaggaaaaaaacaaaaaaacaaacaaagcaaaaaacaattctagtacttagttatccctgtgggaccaagctttcttaatttcaagcctcaaaaacttttaatttaatgatttaaagcaatcatccagtataattttagagcaaattttgttgaattataccataagaggaaaaagcacacaaacctaaatgtaaaatgtggtaaatttccatgaagataacatacccatgtaagcagcaattagattaataggcagtatattgctaagctgtagaagcccccatttgtgtacctttcagattctgcccccaccccagagtaactactattgtgatttctaagataatattcatattatttaccaaagagagtgtgttctttgttctctagcttcttttcctcaacactgtatttggaaaagttatctttcttttttcttttcttttctttttttttttttttttttgagacagggtattgctctgtcacccaggctgtagtacagtaccatagtcataactcattgcagcctcaaactcctgggctcaagcagtcctcctgcctcagcctcccaagtagctaggactacagacatatgacaccacacctggctaattttattttatttttttgtatagactgggtctcgctttgttgcccaggctagactcaaactcctgggcctaaaggaacatttgtctttatatatgtagttgtagttcattttcatcttcatacaaatatgttataaattatttattcattttattgttttgttttgttttgttttgttttgtttgagaaagagttccactgctttgcccaggctggagtgcagtggcacgaactcgtctcactgcagcctctgcctccagggttcaagcaattctcctgcctcagcctcctaagtagttgggtctacaggcacctgccactacacacggctaatttttgtatttttagtagagatggggttttgccattttggccgggctggtcacgaactcctcatctcaaatgatccacctgcctcagtctgccaaagtgctgggattacaggtgtgagccactgtgcctggcccattttattattggtaaatatttgttttatttttatttgaaactattacaaatcatgctgctatgaacattactgtatacatctttttgtataatgcatatatatttctgatgggtatatagccagaagtggaattgcttgattatgaggcatgcattttttgaagactgacagacagttttctcaagtagcttcttcaatttagattccaaccaatattctctattttctaagagctccacattcttgtcaacacttcgtattatctttttcattttaaccattctagttgagtaatatgtagtgttatttcattgtaattttaattttcacttcactgatgtctagtgattctgtgcattaatttttttttctggacttttgaagtgttctgtatgggaaactattcctccatttagctagctattttgctggaaattattgtataaaatatcatctcataatttaacagtatattccttcttctcttcaaatttttattaaaataatttttcagtactcttgaagtcaacttttaatttgtccaacctgtctttgagctccccctgctgttttctatttaaactatatacctgttgattatgcataattttctttaaaatgatggattcttagccaataagctattttaagcagaagcattttttttgccaaagactaagggtataaaataaatttaaatgctaactcaggatataagaattattaaaattaatgcttgaaaactagtatgttacatatgggaaatctgtataccttcataatttcactgtgaatctcactcctctaaaaaatgaagtcttgaaaagttagtattttaaaatacttaccttacttgtaatgtgaaaccatttatattaatttagcaaatcaatgtttcaaattattaacaactagacaaactactgagccatatgttaggtatattgtaagcatgttgaagtcaacaacatgacttctacactttctactttctcacggttcccagaatatctattttgacataattattgaaaaaaaattaaaagcatttattccattgtcttgctacatctaaattcatggtgttatgtttctttagggcaatggagctgaaatgaataatggataccatgtagtgtttttatatatttcatctatgagctatgacagatatctccctacattccagcagaaaaaaaaatgtgcttctttcctaagcttgccagctataaaggcctattagacattcagagattatcaggaagcaaaaagcttcatagtcttaacaacgtaaatctgaagtcttagaatgagttcattagaatatagacattgaatatgaggtaagtctgagttgaaattctatctctgacaactgctggatctgtttttggtttccaatagtaaaatggcactaataatgatatatgcaaaatgtaaaatgcttagcacagtgcttggcacatagtagattctaagctgtagtttaaacagctattgtgctatgaataagccatacgttgacattttccctcttgagaatgtgctatttaagtgtagaaaacctgctttcccctgtccgtgtgaatttccttaacattcatcttggaaatgataccacatacccttatattgatgcactgcaagaggccaatctaatgtaggcataaaaagagtaatctggtaatctgctcttctcagcaccctctgctaataatgctgtttgaacaaattctagaaagactgttgatgccagagccaactcagaattaggcaggtgaatgttttcaacttctgctaataataacatcagttctgtactctcctctgggttctttttgctgtattaaagctgcagttcccttaggttagcttctatgcataacctgggaatgcatattttagctttttacttccctcccaaagaaaggagcagaagaggagaaccaaatagccaagatctagaagatgaaactgttgtatccattgtgtggattcagataagcctccacccaaaatatggttcaaatgttaagactaatgagcagccctacacttctctctctctcactttcacacacacacatacacaaacacacgcgcacgcacacacacacacacacacacacacacacacacacacatatacccctaccaagaaagtatgaaagtatgtattacttataaaattatgaggtttttctggggagagcagagcaggcctcccaagaaggtctgaagtagcttgagagagcagggggaaaatgactggtttgagattttatgacttttagtgggtgaggccatgctgagagttttgtgtgggtggactctggtgtggtttgaatttcccaccatcaccaaaggagagaacacatgggctttcttaacagttttcccaaatgtaggacagaggggaagagagaggtataacactttaaagctatcagcaatgacacatcaaaaaatggacatagattttttattacagaaattaaattgtatgagaacagaaatgaatcccggtgctacacagctgatgtttcctaggaatgagaactagggtaacttttttaaagcacgtgtttatattgattggtacatactagttagccaaatttaactgggttgagatggtggactttccttttgaacctcagttatgcaaattgtaagaattgtgtttccttcaaattactcaaaataatattgaatttcttacaaatgcaaaatgaattgtggcttaatgtgcatatgtatataacagatactttgttcaactatattatgaaatactatagtatgtaactttcttaaataaacaggatgacaaatcagtgttaggattcaaatgggccctatattactctgtatctctcataggccaagtgttaattctggtacacatgacatttagcacatgctattacatttattgattgcatatttttatctgttatcttttggttcattctacaaggattcttcaaaagaaatcaagtaatcctagaccccaatatataaaagaaaccaactcatcctagacccaatatataaaagtaaatgacattttgttcttgtcttaataagttcacagtatttcaggaaacatgggaatacagaataacagataagaaatattataagacttctagtagagaaatatgcttaaaatcatatgtatgttcctttacacctaagaacctttagatataaatgcattttaactgttctggagagttccaactccaaaatagcctttgttcatatcaagaaagtaaaccaccttctatttcaggtgggcttactcaccatacctggggccacattactgtcccagctcactgaaaggtcataatccaggatgaaaccaaacttgaaaattatagtgaaacacagtagaataatttagaagcatatactttgatgtttttagaaagtaaggaaataaaactttaattgaacttggaataaactcagttctgagcattccattctactctgcagttgtcatttatagacagctgtggatcataatacctatagactagatatcgttatctacttatttatattaatgacaggatatccctgggcaaacagcatcaccactgtactgtgtattcttggttgtcatgggaacctttgctgtgaaccagcagtgagagcacttccattgaataaagctgcctctggatagccatgagttgcatgaagttattttactaattttatttgccttttacttgaaagcataagtttctgaggatgtaattacagtttcccctatatttctacagaagtagttatagatgatggacctcctgaacttttatcactttgccatactctgtaaaattacctaagagctccagagcatgaaattaacactcaggaatattgtagcctaaccttttttgctactctgaataatactgaattgaagggtcttccacagcaagccctctttaaattatgctttctgatgctttacctaaggctatacacttgtctttagattcttctagattattttctcctaatacagaacttagcatttaaatgacaattttaaaaattgagatcaactcttcaaaagaaatcaagtaaaagcaatttcagcaaaaaaaaaaaaaaagccttctaatctcctacaaaacacctctatcctatcaagatattgtgattgagaattagaaatagtgtggaatcagatgttagtttgtcctttccttttcactggaatttctccatgctttaatttttatatcaagaaaaacaattcttgcaatattccctaaggagagttttacaaaaaaagagataaaacaaactacacacacacacacacacacacacacacacacacacacacacacacactaccttaaggaataaagaaattatctgagtggaaaataatggtgctttcaattttcctaattgaattaaaataattatctaagtctttttgatcttgtcccaaagtgaataaaatgtctttttttaaatttatgtttcattagatatatctccatcttttcagtattcaccccaagttttaattgggtagaagaatatggaagaaattcctattgctcagacaccatgtttaaagctttctgaatgtgatctaatacctccattggttggaggtaattaaacagagatctgttcttttaaacaactatttgagtgctttaaatctgaaagtcatgtcataaatgtcagacctctttctctttgctttaatcatctcagaaagacttatctgttaatggaacatctgcatataggtattttgttgaccacaggtgttccacataagtttaatctacctattagttatatgttcatgctattgaggacctttcaataataaactttactgagtgcttactctcttctaagagtaatgcactatgctaggagacaggagggatataaaggtaaagaaaccatggcatgaatctttagggagattataatttagtggagaacactagtgaaaggaggcaaaggaattaatagaacaagacagtttctctgagtctccaaaggcactgtaaaaattcctggggaaactgcaagcaagagcaaaatgttagctatcataaacattctcatgcatcttcaggttttatcttcatccataaatttacccattaaatttagacattctactatctattccacttgacattccaattagcagctcagcctcagcctatcaatatgaatgcacatcgcttccctgttctcttgctgtgccagtctttccccagtgtagttaggtagtgtctccaatcagtcaccatcaccatactgtgctgattttatattctgaatattttttaagctttttcctttttatcaattgactacactagtttagatcttcatcatattattgtacacaactgctgggttttttctgtctggaaagtctattttcctctttcctccccagctgcctctttcttctgcctctggatgcatttcctcattttcctgccttccaagatgtatttaatacattcctctgtgctctcatatgctgatacatgtctgtcgctgtatttgctgtgtaatatccaaattatttgtgcatgtctttgtttttctccaaaagttgcaagctccttaaggtcaggagctgttctttaatatatctactctacctagtgtagtcatgcttaatatttgttgaagtaaacaaatctgaaccccaaatgtattatgtaatctccatatcccagcacagataaaggatatgctcttgaattgttttattgggagaaaacagctgacagattaggctacacaacaactaaaaactaagaaatgactacatgataaattgtaatgaaaatcggaaggcagactgactgaggaatatatctctaacaagtattcaaagatataattttgttattgttaaaaagaatacaatgaatggagagagggtttggatttcacattcaggacttctgaagaccaagtataagagattcaaaagtgataatgtgaatctgattagaaaattcaattttggaatttaaataagaaaaaaattagttggtctagcaggtgaggctataatatggaaaaatgagaaagggatacagcactgaaagtgaaaatgtggaaagagagaagatcagaaggggagaaaaaaagaagaaataaagggttagagtttatgaactgtaccaaaagaaatgatacaatggccagtcctgtgagggtagtagagggatctctttattgtattttcttattttatttttattttagattcagggagtacacgtgcaggcttgttacatgggtaaattgcgtgaagctgaggtttgggcttgtaatgatcccactgcccacgtagtgacataggaccatagggagtttttcaacacttgctcacctccctcctcccacccttttggaatcctcagttgttcagtgtttccatatttgtgtccgtgttgcctccagtgtttagctcccacttataagtaagaacatgtggtatttggttttctgtttctgtttcaattcactgagaataatggcctccagttccatccatgttgctgcaaggaacatgatttcatctttttatggctgtatagtatttcctggtatatatgtagcacattttctttatccagcccaccattggtgggcatatgggttgattccatgtcattgctcttgtgaatagtgctgtgattcacatataagtgcaggtgtctttttggtagaatggtttattttcctttgggtatacactcagcagtgagattgcagggtcaaatggtggttctattattagttcttgagaaatctccaaactgttttccacagtggctgaactaatttgcattcctgccaacagtgtgcaagcgttcccttttctccacagtctcaccaacatctgttactttttgatttttttaatatactagccattctgagtggtgtgagatagtatctcattggttgagtgtggtttgctaatattttgtggaggacttttgcatctgttcatcagagagatattggcatgtagggtttttgttgttgtgtctttgccagattttggtatcagaaagatactggttttgaattaggagttcctcctccttgatttttttttttttttgaatactttcagtagtatctgtatcagctcttatttgtatgtctggtagaattcagctgtgaatccatttggttcagggctatttttggacattaggttttttattactgattcaatttcattacttgttattggtctgttcaggatttcagtttcttcctggtttaatcttgggaggttgtgtgtgtccagaaatttatgcatctcctctaggttttctagtttttgtgcatagagatgtacatagtagtctctgaggatcttttatgtttctatgggattggttgtgatgtcacttttgtcatttctgattgtgcatattcagatcttctctcttttcttgttaatctagctagcagtatatcaatctttttttatcctttccaagaacaaacttctcattttgtatatcctttgtatagttgttatgggtctcaatttcatttaattctgttctgattttagttatttcttttttttctgctagctctaggtttagttttgttcttgtttttctgttttttttttttttttaggtgcgattttaggttgttaatttcagatgtatcttcttgatgtagacattcagtgctagaaactttcctcttaacgctgccattgctgtactctagaggttttggtatgttgtatctctatttttgtttgtttcaaataacagtttgacttctgccttaattttttgtttattttagagtcattcagaaacaagttgattagtttcctgtatttgtgtggttttaagaattcctcttgctgttgatttctgttttttttccactgtggtctgagaagatgcttggtatgattctgattttttgaaatgtattaagacttgctttatgactatgtgttcaatcttggaatatatatcatgtgcagatgagaagaatgcatattctgtagttgttgggtggagtattctatagatgtctattaggtccaattggccaactatcaaatttattaaatacaaaattttttgttagttttttgcctgtctattgctttcactcgtgtgctgaagttccccactattattgggtggccatgaaagtcttttcataggtctataagcaattattttataaatatgtatcctccaatgttgaacatatatatatttaggatagttaagtcttcttattgaattgaacactttatcattatgtaatgcctttcttggtccttttttactgttgttgtttaatgtctattttttctgatattagaatagtgatccttgttctttttttgtttcctatttgcatgatagatctttctctatccatttacttgcagcctagcctatgggtgccattacaagtgaaatgggtatcttgaagttagacttgtttttagtctaatttgccactttttgccttttaaatggagtgttaaaacactatgacaggaataaaaccttacatatcaatattaactttgcatggccaaagttaatattttatgttaaaacactatggcaagaataaaacctcacatatcaatattaattttgactatgcaaaagttaatattgatatgtgaggttttattcttgccatagtgttattatctggttgctttgtagtattgattcagtcactgcttagggcctgtgggctatctgcttgcatgtgctttcatggtaacaaggatcatcctttccttttgttttcatgtttagaactctcttaagtatctcttgtaggtctagtgtggtggtgatggattcttttagcaattgcttatctgagaaagaatttatttctctttcatttatgaagtatagttggtgggatatgaaattattggttggcattttttttctttaaaaatgctaaaaatagtcccccaatctcttctggcttgtatggtttctgctgagaagcctgctgttagtctgatgggtttccctttatagatgatatgactgttttctctagctgccgttaagtttttttctttcacgttgaccttggatagtctgatgattgtgtgccttgaagatggtcatattatatagtattcttccaggaattctctggatttcttgtatgtgcatgttgacttctctggcaagattgaggaaatttccctgaattatatcctcaaatatgtgttccaagttgcttagtttctcttatctcagaaatgccaatgtcactttacataaccccatatttattgaaggttttattaattgtttaaaattatttttttctttatttttgcctgcctgggttgattcagaaagctagtcttcgagccctgaaattcattcttctgcttggtatagtctgttgttaaggcttccaactgtattttgaaattcccatagttaatttttcaattccagaagttgtgtttggttctttcttaatatagctatgttgtctttcaaatcttggatcatttttctggcttctttgtgttggatttcaactttctcttggatctcattgagtttctttgccatctagattctgaattctatatctgtcatttcagacatttcattctggttagggttcattgcttgggagctagtgagattctctggaggtggtaaaacactctgacattttgtattgccagagttcttgtgctggttccttctcatctgagagagctgatgcttttttcttttcttttttgaatttgctattgtttggatggagcttgttgattttaaattcttttttcccttgtgggtatgactgtggtgtaaaatgtgtatgggtggatcagcttcatttctgagtgctttcagggcgccaaggctctgtatgggttccttggttgcagataagtttgtgcggtggctgagacgttgcttcttgtagtgatgtaattttgttttgtagtgtaattcaggctgcagcccagtaggtggcacttaagagtgagcgccagaaggtaggggcaagggcagaagcaatggaaaagtctgcaaagtgccctccttcagcgcgtttgccttcagtgggagtggaattgctggagaagccccaaaagtggtctctttcagcccacactctctcggttccgctggggagagccaccttcgagtccgcaacagtacactgaagagggatgagagaggtgagcgatgaccccttctcgacaaccattccctggctttggtggcgcccccttcagtggctagcgcagtgctcctgtttcctttgacccaacctttgacccaagaggggctttagccggctacatccccctcccttaggggccgactgaaccgagggctagatttctaggggagtgggtcccttcccttaccacttttcagagctggtgggttactgtcccccaactgaacaaggaagccgactggggaacccagtagttgatatgtaagggatgctgggaagtgctgggtaaagaagggtgagtccctggcgagggctccacccccaggcctgtgcccacggacctaggtgaggacaggcactccagcctttgggcccaaatgttgcatttcccaagaccaacctagcctaccatgccccctaccatcctgtgcctataaaaaccccaagaccctagcgggtagagacacaagcagctgaaagtggagaggacatcgaggggagcacgctggtggaagagcacaccaacagatgctgccacctggcaggccgtccagcagaggaatgacgcggagtttggtcgtggcagtcataggagagcccgggctgctgagcggctggactccagggggaaaccatctcccttctggctcccccatctgctgatagctacttccactcagtaaaaccttgtactcattctccaagcccaggtgtgattcaattcttccctcacgccaaggcaagaacccgggatacagaaagccctcgtccttgtgataaggtggagggtctaattgagctggttaacacaagctgcctatagacggcaaaactgaaagagcccatggtagcacatgcccactggggctttgggagctgtaaacatccacccctagatgctgccgtgggatcgacccccacaacctgcatgctcccctagaggtacgagcagcagggcactgaagaagcgagccacttctccagttgcacaccttgcaagggggacaagggaacctttctcatttcgtagcaacacacgcagactggttccaggtctcaaagctgcccctagctgcatgtcttgccacccagaagaaacctggcttcgggaactctcctgcccctgcagtcttctaatgctttatgtctcttctctatcgcatccaagcattctctcctagactatctgctcagaaggtgtccacttactattctggcgtttctctgttggggagccacacactacctgcttctgctcagccatcttgatccctttcatgtctctatttatgaaggatgaaaatggaatggagacatggagattgaggattgatgatgaggcttgttgaaatttgatgataatttcactaagaaacttagaaacagggccagggggtaataaatgagagacacaaagagaatggagtaagtagatatgatggacttgcaaagaaaaaaccttgttgaagagcagacgtgagctaatggactaagagaagcatgcaagtggggagactacttctgatagtaaacattttggaagagtgtgccatcaggagaaagcccgacttcagtgtggtcaaggagctgagcaagttatatccagaagtgatcaaggatatttgtgagtttgcttacaatatcataaaggcaggacaagactcaaggaagattcctagggaggaaactggtggggaagtcaaggccaaactgggctggataaggtagaaagagcatattgatgaaaataacagccttaggtgggaattgtagggggtaacttgaaggggatttgaatacaggagcctgtgttaaaaactagctttttcttttcttgctttttttcttagaaatgtatagaacacatccatttattccaacactccaagtgaggaataaggtttgggctcagcttgtagtccgcaccaatcactgagtattattttgaggggcatgtttacggggaaggtacgttgctggtgggattgtttcaaagtcttaatgcaagtgcctcaggtctattgctagacatttagaattttcttggttttttgaaagagaaagattagggatagttaatagtagtttaaaagactgtgcaaccttagtaacatttctttgcaataattaattaaaatcacaaggaaaatttttgcaaaagtttgggcatataaaataaatgaaagttatgactaacagttcaactttctcctgatgtctcacttttgtgagaactgatgtagaccagaaaataaatttctaggtgttttttgtttgtttgtttgttttgttttgttttgtttgcttaggttgacagatctaattttcatgtcaaattaggacactgactttccctaacagatgttcaggagctgaatttgtatcctaattctagtcttgctagtatttatttttgagacctgcaatccatcattatactaacatggcaatgcctaggaagtttaatggctatacgacttctagaaagtgcctttattacatatctgacacattgcaaattcacaagtggagtacaaacaatttcagcagcttagatgacattttccttcctgccagtggtctgaactcaccaggtagcaacacccaaagcattacattctgtctccctgagttgcattgtatttttgatatcacagcataaactgtcaaaggaagtatttctctaattttaattggggttactagggtcaaagccaagtttccaaagctcattttgtttttatcttattatcatgcatttatagtaagccatttattttttgaagcaatccttattataacttggaaaaaaactatttcgtaatgtggtcagatgtgattagatcactgttttatgctcagacgtatgttccaccttttcccataatgctgtgacatttggggtttgtatagcttcatgaatcgaacttaaacagtaatgcattttcacaaataaatagaatcactcttcctacctattatgatggatcttaaaatatcctgccacatctctctcgttattcattcagtttctgatcttagtaatttacctatacattaaaacattgtaattatgtatttaaatcaccaggacacctatcatttggtctctaaaactgagttgctggttgttagagaaaaatgtatttaacttgtatttatgaatataactggatgagattctggttatttaataggcagtttaacttgagaaacagagtagatgggaaaaatgagaacttactgtgctttaacaactttacattaatttgttggttcattgtgagctagtttattacagtatattgaactgtttaccaaatagtaaactcgattccagtgtttagaacatgcttttttaaaatgacattcttaaccattttgccttattgcaaggcatttacgtatatacattgagaagctgtatctgatcatgtttctgcagagatgtgttatgaactgctttagtacacggatttttgaatcttaacaaaggattttggccacctgcaaaataagaggttttcattctttttagaatagtcttttttctgggtccccagtgtatattttgccaaaatgcctaaaatattgcaataaaaaaactcagagtttggtaccaatctgacaattaatttttttaagcctttaaaagtatataaacaattttagccaatggacacctctcactgaattgaccatatagatcatattagtccattttcacactgctgataaagacacccttgacactaggaagaaaaagaggtttaagggactcagttccacatggctggggagacctcacaatcatggcaaaaggcaaggaggagcaagtcgcgtcttatatggatggtggcaggcaaaaagagagagcttgtgcaggggaactcctctttataaaaccatcagatcttgtgagacttattcactatcatgagaacagcacgagaaagacccaccccataattcgattgcctcccaggacacatgggaattgtgggagctacaatccaagatgagatttgggtggggacacagcctaaacatataatagacctatcagttccctacactaataaacttccctggtattatttccacagcacatgtaccctggaaaattagctccaggtgatgagaaattcagttgagggcagtaaaaaagaaaccaggtattctcacactaatttgagggtttaatctcactgggcctcctgtttgtttttagtgcattggaggaaaattagattttctgagtaaatagaaatgagcaatgttcctatgtatatacacttaactcttcaaaaagaacaacataggtctgtactggcacaagtaaaatgttgtagaaattgggtcaggtgccaagtgtgagcaacctcactctccctaatcagacagcatttcttatattatttctggattaatataagtaggtaatcttgaataaattctctagtgaatgttctacatcatttattgtcagtgaatgtacagatgggatagtcccagtaaatttttttagaaaaccaaaccatgttcaggatcatggatacttgtattcaaggttttcatgggcattcaaggaagaaagaggtgatgcaacatgccgtaagccagattctctagaaaacagacttggaggcagagatttaggcccaagaaatttgtttgggggtggggttctcttaagatcaacacctgtgtgcagtagatttctctctctttggataaaggcaattccaggagagagacttagctgagaagactcccagctgctgggggaatgaatgcctcaatcctgaatgggtatctgggttgcatatttgagcaaaacatcctaactttagtaaataaagctacagctttttcttatttctcctatctgcttcttgcctgggcaacctaaaatttatccattatccctgctatctcaccaggaagagtatagcgataaagagcaatttctatatcttatacattatatttaactataacatttattgttattagatagttagattaagtaagaaataaggtattcatgattcttttgaatctgtgtgaatatacatatagttaaatagtgacattgaaagtatggtgaatttttatatcatctttctggagaaatactgaggaaaatacttgaattttgcataaccaaggcatcagttactattcacaatgagactacagagaaagctttccaaaatgtttaaatgaaatatgctttcaatgttatgtggttttcctgtgatgtagctacttaattagcattgtatcaatcaccactgacatcaaatatgataacttgctttactggaaagtcactgctcaatctcatgaatgaaattgatgaggtagaaggtaatggtgcattgccaagaaaacaagaaagaagggagctaaaaattgagagttacctactttgcagtatctgctttatatatggtatctgatttcagtttatctgaaccctcccctggaagtagctattatcaactttatgttatttacttactcattttattctttttaaaaagaataatgagatgttttaaacatagagaaaagtgcacagggcaatataaaatcacatacataatcatctcccaagagtaactaatgtcattataggtaaagtttgcttcatatcattttaaatataaatattgcagatatgcttgaaatatatgttaggccatatgtgttcaagctgaggaaaggtaggttcagagagaaataatcttggccaatctcactctgctagtaagtagggctaagatttgatcgtctatacgtggatcgtggaactcatgttctttccctccactatgtatacttcctctgtactccctgaagacttaatctggatagagatacattgcctagagtttctctatagtgggagaaatgagccttttactttcgtggtaccacgtcagttgccaattgattctggcacataaaaatgtattatatctttacctgtttaattattttctgtaccacatcaaaggaacaagataaatttggttataatagtttattttactttaatttactattattagtcattgcagtacacaaatgcagatgtctgaagggatgcacaaagatgacaaatgaggcatgtaacatataaagaaatactacatttctaagtggtttacattatgtgtatgaacatgaattacctgcatggattatttttaagttcagaaactgtttttagttggttttctttcttttctatagctgttatttatgtctccagcttcatcttcaaagtggagatcataatatttatctcataagactcttaaaaaatgagataaaagcatttgatgaaagcatatgaaagcatttgactgagcaattagtataaagaagctacttagtacttatttgctatggtcacctgaaaagaaaagctattttgcatgcagtggtagggttgagaaacagccaatatattaaatattttaaaatatttttgtttaagttcaaccacctactttttagaaaatcacttagcatatgaaatttattttaagaggatacttactccacagttgctttagaagaaagaaaaagaaaatcagtttgtaaaatgagataattgtaagggtatctcatctttgtagccatatgagagagtccaaagagctaagcaaatatttgcgaaatgatatttttactatactggaagtaataaacaattaaaatgttgttattaaggcagtgctgatattataattttactatctctagaggaataccagagatcttattaaacacatgcttttttaaagttgaaatcttagataactattatcattactatatgtgtaagaaaacaacggcatggagaaagatgtgctctatagaaaactggtaggttattaaaatataaagaaatagggagaaaactgaaaattgcatgatattgtcaagtctcccttgggactcacccacacaacagttctttcattgcaagtttcttttttccttaatgagtcattttgagttctttttaatgtgggcacaaggaaacaaataaggattcttccatgcagctaaggcaccccaaatcttattaattcaaatgttgagagcattgaagccataaagacaataagaatactgaaacaccatgtatctgctttcatttaaatagccaaacaattctgtattttccaagtgggcttccttaatatacatattttaaaccttgtaaggtaattctccagagaaatatggaggtctaaaagacaaagtaattccatttatcaccttaaatctcatttaattagggaataattctgatatatcaagaaagaaactaattactgtcttctagatgcttgtgcttttgtaagaaacaaaagagctcaagcaagtagaagcctcaggaagagagcagtattacagagggaccacagcaacaatgtttttttttgttttttttgttttttttttttgagatggagtctcactctgtcgccaggctagagtgcagtggtgtgatcttggctcactgcaacctctgcctccagggttcaagcgattctcctgcctcagcctcctgagtactaccacactcagctaatttttgtatttttagtagagatggggtttcaccatattgtccaggatggtctctatctcttgaccgcgtgatccgccctcctcagcctcccaaagtgctgggattacaggcatgagccgtcacgcctggccaacaatccttattaatattaaaatttaaaaattggcttgaactggagaacacttcaaagctcatttaccacagaactttgtcatttttctccttatttgactcatctcagttggaaagcacagatgttttatgcgtctgccttgctcccactctccctaaaattttacttaccagctaaaccgccaatcctaatacatccaacaatattttaccatgaaaatacattcaatttttgtatttagatgcatacaagtctcctgaaattgtgaaatattccaactgtacttggaaagctctctgaagatccccccctcaaaaaaaaaaaaagaagattatctctagtggttatattttttgaaaggtttattgttctattgaatatatatctagttctttttcataaaaatgaatatcctggctttaagtaactgtttgctaagcacagtgtgcacagctatgcacacactgatatcaccattgccaattttattaaaagaaccacaatacagagcaaagagaaaaagagaagtgtccctattaatggtatttcaaatgcgtatttaaacagcttatctactccaaactaatttctgatagattaaatagctgtattccaaatcttacaagatgcacatctctcctctatttctttctcggcttgcttcagctgaatagctcaaattgtttggcactggtaaagcatgaaaatgtgagataaaaaaggaaacgaagctacagcctgagtggcctacaggccttagaaatggcaacactttaaaattcattatattttacattgcttcaacagttacacattttttttttttttttttttttggctcttgatgatgtcagaagatttatctgggatgtctgtctccacgggtaaatagtgaccggggtgaaaactgagggaactagggagcacctagaccccaagccttagtagtcagctctggaatgctccctgcagtgtggggtgtgagtgtggtgtctctgtgtctctgtgtacacactgtgtgtctgatgtgcagaggggaaggcagggaagaaatactatggcagacagtcacttgtggtagctctctaaagggatctggcacttcctgccatttcatggaaaagaggaatgagaaggaaataagcatttgttacatgcgggatctcactggatgctttcagtgctagaagggagctatttctcctcctaacgtctgtaactcaccagatttcactaattcagaggttgctttgaaactcagagtcaaattcatagccagggactaagtcttcatgatgtgcctttttgttttagcctcctttccggcatgttttttgtgttgctctccttcctgattactttttattagtgctatcttagtttatgtatttttataaactgccttaaatgctttctggaaccactgtgcatttaatcaaatagactaataactaactaggaaaatgatagggctgatagcatcgtctgacccatgaggaagctgaatttaagtagcttgtccaaggtcactcagcaagtcccttgtgctgtgagtctggttcttggctttcagtcagtattttcaagttttacctacttatttcctcttaactgaacacgaaaaaaacctcaaatgcttatttctttagctatttctatttctctgcagttaatgtcctatcaacttgaaattcctcccctgcctttcactcccagtagaagtttcgctcacctttcccaggatgcttgaaataccttctcatgaagcatttcttatcctgaaaaagcatcattgttacatctcttcttagacgctcctttgccttctgttttcaatctagaaatttgtttctcccccatctccatactgactaggattttgtttgcttgtttcagtttagatcacaggtgttaaaaagatgatcttacatatttaaatgatggacatatgattcctattatcttctacttctatgcattcctgatagacaactcttaggctggaaactaaaacaagaaggcctattaactatttttgcaaaataaaattgtattcttaaagttaagttcttgatgcagggagaaaacattttatgattttcattttacttcccacaataatacaagcatgtcaagtattgacctacaataaatgcttaataaaaacctagtatttttcagtcactttaacagggcattgtatatttaatgcattaacgctccataggccatgtctcctatgtactttgtatgctcagaaagggaagtaatgtacactggtggttaagaacatattaacctgagtacatctttaaacctcagctccactccttgcatgttgtatgacattggcgagtcatttaacagctatgggtctacatttcttcacctgtaaaatggggataataataatgtctatttaataaatgtattgtgatagttaactgaaataaaacatgtataaagcatgcaatagggcacatgggaagtattttataagtgttgtatgttattattaacctgtaaagaattcatacaagaaggcacagaaaaacatcaattgcaactaagatgaaaagtttgttgctgttagagcaggagtagttaagatggtatgtatttcaaatatccaaaagcttcttctatttctggagagcaaccatgggaagtctattgtggcattagatagtgccacagagaaaagacaacaggatggtgaggacaggagttgggagggtggagccaaggaatcaaataatgtggtttcctagatgacattcttttcagaagcccagaggtgccacatctattacaaagtctctaaccaaaccatatccatgaacctatacaagataaattttaacagagtgcagattgtctttcactctacatcaaactatagagtccagaaaaaatattttatatcatgatagtgataataattgaaggaatcagaaggagttgatcattctctacaagcttgttgtcatgaggagggaggtgaaaagcattaaaaaaaagcttaaacccttttcccaatatttcaaagtagctttgatggtatttagatagcaaactcattttaaagagaataggattttcacaaaacggaaaaatcaagcagctggcatagtaagttatctgaatttgatctgaattgacgtcagggagctgggaatgcccctggcaatcctgcattctctctctttgtgcagtattttgacagtagtgagaatgtctgagtgttaatcattttctgacagtgtaggctctaatcttatgcaaaatgaaagcatttagagattttaccttcttggttccaatcagggcatttcttctagaaaaactattctgcagtaagattgtgtataacttattttacatttgtatatgtttatatatatttatatttatataataaacctaaaaatatgtaactgctaagtttggtagtagcctttcttcaaagcatcattcttgagaagagagtttattttgtaaaaccttactggtagagacataaatctaaaaaacaaaattcaatccagacttttgtatccaaatatgaatgttaatttcctgggtatatctttttttaaaaacttgcagtgtgggtatataagcagggccagatgtctctgtgttaatcatttctactctttaataaataacggtggcgtacagtgaaaataaagcccagatggctgacacattgcacaaatcactggatgcactgtatattcatttcatagtttcctgaatactaatagatgatagagtcatcatctttttatctgttcctcagtcaaataacaagtaactacttactgtgtcttctaaaagccactgtgctagtggctaggtaggttataaaaacccaccagatattgcagatagtaccacaatataatttgctttaatctctatgaccttcagaatctattacatcctagtcttccctaggagactggggtttcttggaattattttaaaaaagtgatccaaaactggatctgattttgccatggggattgcttaactaattggtttattagcttgagtctcatgcatcatggtggatattactggttgtcaagttgtggttggtgaatcgtagacttttagaactctcagagaaattcagagttgacccacattacattttacagatgagaaaatgtgaaacaaatgactaaatggtttcactagagccagacagttactgtcagaattgaagcttaaactacaggctgctaacttgtagtctgcagcttttgctagtatgtatgttactttgtctcagaaatgtagtgaaattaaatgtagtgagattaaaatcggtatcacaggaatgaaggtgcagtaactttgggtttgctgctgccattgactcagggtgggatgaaagaaggggaacggacatcattgcacctgcttcatttgtttgttctagaaggaaaataaggaaatgaggtctggctccacacagtgtttcagtgggggctttaactggtctagattatctagaatttttcaatatacagaacttaataggcacagacactcaaatgataggggagtcaagtattcacaaagatatgacatttacagagccagtctgcaaagataaagatatgctaagtggttgtctgtagacaattatagtccattacaagttgagcataaaaacataagcattattcatcagatactgaatcaccagttagtgctggtatttagatgaaaacatttggcttggaggggaagcccctcaaaaaccatagttttgacttgtttctaagaacctgcctgtcatggaaaagcctagaccctagtggaattccccagggatgttttacatagttgggattctcagtagttgatgatattgggaagcagaacataaccagaggagctgggagtcagccctgcccaggtggggcccaagcaaaaaccatactctgcctttccccaagtcacaataaattgtgttctgctaagttgtagttacactgtctcttcaaacagagaccataataatctttgctgcatttattcagttttatgtttatgctagtgatgtttgtcacttagttaaaattagctttaatatggaagaagagggtatacctctttctggaaatgtaacactcagccttaaaggtaaagggagcagcaaaggtgtccctaaaaagcaacttgcatcctgagcactgtgtggatagaggccactgttgccagacatccagccttagcaggttgcagccttagcaggttgtgctgtctttgtatgtggtcattttggtaccatccagaacccccacttactctcctgctcctccaccaccacctccagtccctggttgcaatgagccacacaaaacagaggaaagtaaacgggcattaccttagtatcagcaatgctgggatatagttctgctggtagctcctcctaaaaatacacccctaaaaaataaaattgtaagaaaaaaagagttaaaaataaaaagtttcagtctccttgccctgggcaggtccttggaactgtagaggattttaaaggctatgaaaattattttttatggaattccagagagggggatgggctcaagtttatatgtgagatacatatttacttatttaatagatttgaaaatttatttctatgtttattagtcagggttcttcaaaggacagaacctatatgatatatgcatacatagaaagagatttattttaaggaatttactcccacagctacagagactgagaagttccaagatctgcagccaataagctggagacccaggagagctgctggtataagttccagtctgaaagctggcaggcttgatacccaaaaggagcaaatgtttcagttcatgtccaaaggcaggaaaaaaccaacctcccagctcaggcaggcaggaggaatcctctcttacttgtggaaggttcagcctttatgttctatgcaggccttcagctgattggatgagggccatccaaatgtaggagagtaaccgctttcctcagtctaccagttcaaatgttactcttatccaaaaacaccctcacacacataccccagatgatgttaattaaatatctgggcacccagtgacccagtcaaattgacacataaaatcaatcatcccaccatgtatatttattcatatgtaaaatagtagatttatgtaggaaatagaaaaatgatggttattattagagaggagcataagaaggaaatttgtgatttgaagatttagagtccattattgctaatgaccattaagcaagaatcaaaaaattttgccctgttatgataatgatgtgtacaccattctaaaaataatccttatttactaaggcatcacaataacttctatgggtccatttcagacacaacaagggcgaatcacctttttccttttatttctttgacttctgttgaatattttttatgaaaaatcttgaatttctaagggcatattcttttatcactacagggatgattttgcctgaatatctgaaatagcattgcaaaatgattttctttagcactttacaactgtaaaagaaggtcattttaaaggcagtatttaaaagaacaatgccacaataagtggctcttctcattgcccttacattcttttaaaaagaagagaccagtagacaatggttaaaccagcatgtttcaacaaacacatcatcacttaattaattgaagcaactttccaaaagtattaaggaattaaaatatgtaatgctctagaataggagaagcctaataagccaaataagttcaactatgaaaaaatatctgtcattttgttaattcacaagctggagagggtatgaatgttaaggggatgttgtagctagcctagagacttactcttaggtctaaggcaggtacttaaaatgtgagagttgaaaagaaatttttttttattatttttcttttttcctgaagaagtgggttttgtaagcacaaaggatgtagagaaaaaccatgctttttgattcagactgcagtggggaaggtatgcaaattaacttataatttctatgccaaagatttttttttggctctttctctaaatattttactaatatcttacggcatacagattggtctcccaacttgcaggagacattttttggaggttgtatttttaatttttttttcaatactgaaaaattttataggggaaatgagaagagccagatgatgaatggcttcaacaaagggactgtggtcaataatgacagtgatgggaacaacgaaatgaccaaaggtcttgatttccaagaaaagtcaaatcatgaaggcttcatgttggaggagaccacagaagtgtggagactcaggcaggttccgggattttaaaactctaccgctggagcagcctttccttaccaccacccaaatgcacccatagagcagggaataggggtcagaaattatggagatttccacttgaagggttccatgggtctaattcaactcccattttagagatgaagcaggtgagtctcagagaagtgaatgatatattcaggacatatggctaaggggtgaccaactgcagactaggcttcttgactcgaacttttttttttttttggactacattgtattactccccagtctattaaaaagtttaactgccatattgaacaagcaagactcatacagcaaagtcagaaaacatttgcctttccctccactgtcattaaaatccaataaagagttaggtcttagcatgccaatgggactctaaaaagaaatcctctctaggattttttgtctccctttgacctcttttaaaggctgtatgtggggtataagctaacggtcagaatagctgcgcctttgcaagtcctaccagatgttgcagcaactccagagtgtaggaatatttgccatctattgttttgtccttggccttgttaggacttctactgcaaatagagacaaagagccttcaggaacattctgctgtgcaagtggtcaccaagttcatgtgcatgacactgccctggtcattgctgtcctggttactctgcaaacactaaagccgattggccttgacttaaaatccatttcaagggaggagaataacataaattgttttaatcagggcaagttttattgtaataaagtaaatgacacaaaggcaggaactacactgccctattggttattatcacctgtctggcacacagtaactgctcaataaatgaatgagtgaacagaaacctattaattggatcaagtaaaaagagacttattggaaagatacaaagtaatttaagaaaaatgtcatattggaaaataatgcctggcttcatggggtattcccatcctggcatattggacccattaacctctcagtgaatctcagtgacccaacatggccacatgccatgatgatgtgactacagtgcccatcgtgaatgaagggaagcagaagcactcttgagtggtctgggttggaccagaacctgggtgttgggtggtagtgggaaatagataagggaggtaatctgtgacattggcagatggcatttttattaaatctcagactattcagagagtacgtgggaacattatcttcattgtaatatgatcttcttgaaaggatagttattcaaataaaaatatatactttccatgtatatgaacaataatgttgcatttattctaatgttacatttattctaatgtaaactattctatcctttttgataactttgcaaactgaaaactattactgaacagtttgaattaaaaaaaaaagcttggagtactataatattcatgaacaaaaatcttggagaatttcttctttaatgaagttattgaaatgctcatgcctataaaatttttcaatattgaaaaaaaattaaaaatacaacctccaaaaaatgtctcctgtaagttgggagaccaagagaccaatctgtatgccgtaagatattagtaaaatgtttggagaaagagccaaaaaaaaatgcttggcatagaaattataagttaatgtgcatactctccccactgtagtctgaatttacaagatatatgccatgattattctctcagaagattttttatgagttcagtactgtcttgattaagcttatgactaaataaacttcttttcatgacattgtcgaagagtatcagttttcagacagtgagaaaaggacaagcagctggaatcagctgagaacccaacaatctattgtaaaaatacggtttattttaccactcggcatatgtattcatacacatatatgtatattcaactgagacaaaagtttcacaaaatcctgcttactcttactacatgtgatgatctctgatacatgtgatgatctctattctgtttgttttaaagtttgtcacaacacatgaaatttgtttcacaaccttcctgttggtcatgagctctgtttgaaatatgcagactcaaggcaaaaatgtaaatgggaaatttggaattattatccaggttggaaggattaaaaaatagaaaatacgtatgatttcacctttctttcttctgaggccagataaaggtaactagtctgaaatctagttatttatttatctggaattgtttagggttaaccatagctagtaagggtagactgtggatgtagtacagtagctacttaaaagctgttatgtcatgagcctcccaaccatgacggtgcttaggaactctccagggagcattgtaaagtatgcaaaagtcctggaaactctaggccaagtgatttagaatctctgagcatggggcctgagcatcagtatttttaagaaactccccaggtaattgtaatatgaagctaggacccaaaccatcaatagcaactctgagtagatgcctttgccttgtgcactgaatacttttgtcatgttaacaatgcttttttgtcatattttatgacgtgtttcttgtgtatcacccaaaagcaacagatatttttgaataacagaggttactatgagcatacagttatgcacatcattgaacctcaaattttaagatacttattactaaaatgttatactgtgatttattgaaaattttatgaagaattcattgacaggagcaggttatatgttaagtgctacttttctagttgaatgtggctcaggagaaatctagttaactaagtcaaatagatagtttttaatacttatatttatttaaatagtagacttccataatcctcagttattttatgtcttccaaaaccaaaaataatttctttaattttgtcatagattttaattgaaattggtgaacatatgcacacatacacaaaaactgtagatttagtgtctgtggtatgtaattgatgaactgttttctaaaaggattttgaacgtttagaaaactaattaagatatttaaattattgacaaatagaggatctttctgtacccaatttaaaaagaagatacaatgatttgtggttagtgtatccatttttcaaacataaacagaaacttcagaagttcttaaaaacaggttgtccttttagataatttctacatttcctctgaaatcttatttctgaattaagtctagatgtttacaatctatctgaaaaaagtaatgttgttataaacctcaaatccgtgctcatacaaattcttaccatttccaattagataatactctggcaagaattactaatgcctgaaaaaatagatgtaaatattcccatatgatggtaattattaaatgttatcaactaagtatagtgttttgttttaattttaacttttattttagatacagggggcacatgtgcaggtttgttacatgggtatattgtatgatgctgagatttggagtatggactctgtcacccagatagtgagcatagcatccaataagtagttttcccacccaaactctcctccctcccttccccttctagtagtctgcagtatctgttgttcccatgtttccgtccatgtgtactcggtgtttagctcccacttacaagtgagagcgtgtggtatttggttttatgttccagcattaatttgcttaggattatggcctccagttgcatccatgttgctgcagaggacatgattttgctcttttttatggctgcatagtatttcatggtgtatttgtaccacattttctttatccaaaccaccactgatagggtgggtttcatgtctttgctattgtgaacagtgtggagatgaacatatgagtgcatgtgtctttttggtggaatgatttgtattctttgggcatatacccagtaatgggattgctaggttgaatggtacctctgttttaagttctttgagaaatctccaaactacttttcacagtggctgaagtaatttacatgtccaccaacagcgtataagcagtcaatttcctccacaatcctgccagtatctgttgttttttaactttttaataatagcctaaatgtagtattttaaaatatctaagagtttcttacctgaacctagccaatgtattttttcatcttattaaattacatacacttttattttagccctcattgatttattaggtatataagtaagcatattttgtagagattctttaatttttttttttttttttttttattatactctaagttttagggtacatgtgcacattgtgcaggttagttaatattttatagcactaatatgtccttttgttttttaagaataaaatttataaattgttttataagagtaaaatcaatgtaatagctgctgctgctcagtacaattaaacaagttacagaaatcctttactcagtatcactaccaaattttttctaatattctcattttaattttttgtaggtggtttttacagttgcctttatatattctgtcaattgtgaatagaaattcaaattcttgaatttgataattgtgtcatttttgtgttccctagcttttatttgtagactgttggtcctattgttctttttcatgtgttactattatctctggatattttcttataaattattgaaacttatgagattcaattaccttccaaagtgatttattgttacgtgctgtaatgctattaataagtgtagtttgcaagcaatgtttcaaaattttgtctacttaaaatttagaacaggatatttattttgtaatttttggatagatagaaaatctcctttctgccatcatgaaactgataaatgagttatagggatgggaggagatggacatttgaccacatgcaatgcagttttccaaagtatataaccataatctatattaaaggtaaatgcagtgtcagatgggcattactttatgcaagattgtgttgctcatgaacttaccagccaaaggagactatctctcactaaggcttatgtaaaactgccaggagagaataattacagtgggagtaaatttgaacacatgcagtagaatgtctaaaagttaagcttctcagagaaaatgtacatatgcttggattttacaaatgatgtatttccaggtattcactaggcctgctaaaataagttagcattttttaaagataaatatgttactgaaatatatcctacataaagtaccaaattataggtttacagtttgatgaattcctgcaaagtgaacacatctatgtaatctccatcctgatcaggaaatagaacattgtcaattctcccagaagtccctggtaccataccccagtcccctcccaccacatcacataagattaggttttgtctgttttgtttttttaccattttgtgttcttggtgagagtgctgcttttccataagcaatttcactgtatccagaaacagaactcagttaaattttaaggccactattttcttcataaaatagagggaagggagaataggttggtgggaggaaactcgtgcttctgattctttccctagcctatgatcaacataatcatgccttaagaaccttgctttctgtctttgagtgacatgcttggaaaagtttttgaaaacatcagtttgtgttctttacatattcattgtataactctattttatatggtattaataataaaatggaaacaaacagaattgtggaggggaaaaaaagagaaattttaaagacaagcctgccctctaatttcctttttgccatgagtagtcagtgggaagactctgggagcttggggacattgaggcatacagcagtcaacaagcctgagccctacaacgactgagtctggaaagtttagattctgaaagcctaaaaaagcactgtgtaagaggctaagccaacctttttgttgttgttaatctttttactgggagacaagaatggaccttagggatagggtaaaaaactgagagcccccagcccctttaagatattttctctaaacctcttaaagttaactctgattaatttcttggttagaattcaagttatggttcctgctctgcaaaactaataggtagtttaaggtgggaaaagtaaaaattcttgccatctcctacattgacttgagagtgaaagtaagactacagatttgttatccccaagacagttgtagaaaactgagattatgctttataataccctatttcaagtggggttaatatataaccatggttcttagccttatttggggttagagacccctttgagaatctgaataaagctatatgtcttctctgaaaggtgtacctaggtacacataatttagccactggccttgtccgtttgcaggccccgtaagctaatgcacagttccctctgaggatccctcagctttattctaaagtctaaaattctctaacggttgccagtggaaataatccaggagtgatagaagtatggtccttattacagttatctaggaaggagaccacactgtcttcatcctttacccttccttggtttcaccttcttccttcatgacttgaagattcctttattttctcttacttccaactcaaaattatattggttcatgctggtttcctttgtttaacagaaatattccttttgcaaaatggtaaacacctttttagggggaaaaaaaacccaaccaacactgttcctacagttgtagatagtaattaagtcaaacccttagttggttttcatttttgaatttaatactgcaaaaaattaacttttttgcataaaactttttatgacttcagttattaatattttattattttgattaattttatgtaagtcaagatagtctaggttattctgcagtaatccaaaatctaagtggcttaatataacaaattttatttcttgttctcttcatacatacccaagagggattggcaagaggctctacttattgtagtaaacctgggacccaagatgattgatgctttatctcaactcaggcttcttcaccagggaaaaatgatgtaatgaatccgtcacaggttgcctgaactttcacctagaagtgacacataccacttttgcttaaaataattggtcaaagtatatcccatgttcatgtaggataccaaaggggaggctaagggcaatcttaccatgtgaccagaaaaaggaaagctagaagtatttggtagacacattcactcttttctgtactcctttccaaattctcctaactttttggagatttgattgatgttaagcagaaaaagagggtttgagtcttatttttggtgaaagaaaatattcttggttaactttgtcatataatatatctgaacttaaaataagtacacagtggcatataatgaacttaaaagaaataaaatactagcaggaatgtaaaaaacctgaacataacactgaattgctcttgttagtgttatgccacttagttccatctacagtctagcccttgtaataacacacacaccgtgattttagttaaataggaacatgcccctttctgtttcatttaaaattctagtcaacacaaattcttctagaaaaatgaattaagaatgagtactattcccagagtacattctggtttgtctataaattctaagctaagctttatatgggaactgtcaaaggcacagttgcaatgttgctgccttttttattcaggagaactgacttctgttgtcccacttggactgatatgttgagtgatgaaaagctgggcaaatctcctcagtcactttcttctgatagtttactttatggcttccttagtggtctgcatcattctttcagcctgaccatttgcttgagggtgatgaagagtaatgatgacaggttagatgagctctagcttcacaaatttcttaaatgcatctgaaacaaatgcagattcattgtcaggaataataacatctgggaatctggacattgaaaatcattggtacagggatgttcttgttgaagtagagacactataaggcattttgagatggtagccacaacaaacaagaaattctcctccttgaaaaataaaagaattattgatcaaatcttcctgatcattttttataggaaggaaaagtacctttggtggattatatggagtggcttggtgttgtctacagtcttctaaatgacataattaagtacaggctttagatataattattagtgtatatatcattttaaaattcccaggtgaattgtaaacattattgtaataatgtgataagttatgtgatttctctattctggccactcgaaattaagaattaaagctttgattagaaattagagtctaaactatatatttgagaggcattagtatagttgaaactatgagagtattttggtttactgagctagtttatgtgagaaagcaaaagacctgaaacagtcttttttcagtatgtattgtattctagacttttttctaggtcattctttctttccatattttctcttttttttttttttttttttcatgagaaagcagaatgattcaaactgggtataactatattaaaggccatgaacctagctttgtctgacaataaaagtcatgctcttattgctagattaaacttcctcctgtttatagtgtctgatgggattaaagagagaggatcttatgtaagtaagaaagtaatctttttcctacaatctgcttttagcccttactttcctcctatgttgagagcatttctagtccaaagttcttttttttaagtcattaagatgtattattcaatctcaagtaacttttaatccctttgtaaaaatattagctctttaattaggcttggtgtgcctagccagctgtctccagcataattttgggtaggcattagtatgttaatatggaactggcttataatcttaatttcaaagcatattggaaggcaagttttatgaatagtataaagagacttatatgacctgtcaaatcaattcataaaattcctattttgaaggggaaattaaaagtcaaggtaatggaaatgttatattcgtatattcgcaggagatgaatgacatggataggatgtctttgaaagttaatgagaaagctacttgccaggcaagttgttcaagagcaatgttagcaaatgaaatgggttgctgcctttggggaaatgatttatgatgatgaaaaccatctgggtttaggaggttggttgatgtgacatacctctcttccagcctttccactctctcttctttcctgtgcccagcataaaatcagtctttgcgtataaagagcgctatgcaagttggcttccagtcatacgaatatgtggtatgatttcaaataagattgtcattggatgctttggtcagcaagcatatttactttagatttgtatttactctttgtagttgaactggctaaactctaacaaagtatgcttcatttgactttaataaaatattatatttccaagaccgtatgtagtaatagcagaaggtgtgatttctctttttgcataaattggctcttcccttctctttctctgtgtttttcacatctccctactgtcatatatattctgacctgcctctggtagggctatttatgtcatatccataattgttatatattaaccatttgaatgtggaataaggcaagtacagtttaatttttttatataaaaaatatggaatatactgtaaatgagttctcttaatcacggagtagctacctctggaagctgtaactgttggtcttgggctgtaatatattatactacaaccttaaaaatgaagaaaacaaaaagacaacactctatgtgctgctagacaaaggccacagttaaagccaaactgcttgacactttatattcttcaggcctttttaacgaccttccctttgggtgatgcattttgtagctgttgtcacttgtacagcagagagggaaaaggaaatgaataatctgatttgaaggggtgtagagggatgtgagtcttaggaagatccttaggatttacagaagctataaagctatttgtgctgctttgtggtgctttgcaccctgtgtcagttaatagtttatctttaccccattttatgctctaagatatagatgatgttttaaaaatcattctcatagtcttctttcctcaagctccaccccaagttttctagctcctgaccagcactgttagcttttttgatttaatcttcacagtcttctcatttatgaaatacaaaatgaatgctatgtcaagacagacttggaaaaatcttttaaaatggcaatacaggctcacctgcaattaaagtcattccattccatttagtgtctttttctttttctttttgagacagggcctcactctattgcccaggctggagtgcagtggcaggatcatggctcactgtagccttgacttcctgggctcaagcagtcctcctgcctctgcctccctagtagctatgaccacagatgcatgccaccattcctggctatgtattttttaatttttagtagagacagggtctcaatatgtggcctaacctggtctcaaactgctgggcttaagcaatcctcccacctcagcctcccagagtgctgggattttgggatcccaggtatgagccattgcactcggctccatttagcttctgatgagtgtaaatattaactttgaggtcagttcacagtttgctgatattaggactgattttttttaagttatatttcatttaatagtggagcaccttaggaaaaaacaaatctctttatatatagaattaaatttgtgaacttttctgaagtacatttttatccttttaaatatgccacaacatctatcctgtaagtaaaataaatatttctaaatgtctaaagcagagaaatattataaattaattaaaatatttcctgaaaaacaaagtaaatcaatttctcaatttacattattcagataaaaatagctcaagaactagctaaacagtattagtgaaattgaaggtcaagagatgctagaaattagtcaactcaggtttatggaagatcttactatatactctgtaatattcaaaactatttctcggcttaattcactgatgaaattatggtattttggtagttggaattaccaactgtctgcaacagcatgaactgacaagaaaatagtgccctctatgagtaggagtacagaatgttatcttattaacaagaaccaggggacagtaggaatggacaacagcattggttagtggcacagaccaattcaaataatatattttgtgtgattttttttttccttaccagcagtttgttggtgaggcagaattaaatagggaagagaaatgcacattccctatctctgtccctgcagtttcattaaattctgaccaaattatgtgactcagcattctcagagaatagtctctgacaggtagcacttacaggagacagacccacaccttctagcatgtgattcttaaaactctgtgtgcagactggtgcccagctaaccacataaaatttaccaggggtgcttattaaaaatggaaattccaaaatcttacctccagagatgctatcttggtgggccctgagaacatcatgtttttgacgaagtcgcccaatgcctttctggcgtggtcaaaagcaagaagcacaatgcctttttgtgcttcttggttttgaccaagtcacccagatgattgtggtgcaatgcctttttgtgcttctgcctttagcgttggtttgcccagccagcaccagatcaggcagctctattagctgctgctatcagcacgtggatgttctctcctcttcgtaaatgagatctcctctactctcccaaaagtcccatattcttttgggactctttcttttgttagctcttgcttgtcaagaatggaatggggaaatcatttcctatggaggaagtttttctttggcttttggtaactgacagagtgaacagatttcttcgctgggtatgcactgtgccttctcccacctattccagagctgtcactcaggagcactgttcaaggccatcccctgccttccttgtgtagagggctttctgtgaccagcagacagtcaaagacatcgtatctatacacagatggcacattgatgaaaactactgatgtttgccacttattatttattcttttttcctaaatatttacaaaaattacttttctcttttgtatgccacatctgactatgtgtgttagtttttgttttttgtttgtttgtttgtttgttttttgagatggagtctcactctgtcaaccaggctggagtgcggtggcgtgatctcagctcactgcaaggtccgtctccttggttcatgccattctcctgcctcaacctcccaagtagctgggactacaggcacccgctaccacgccctgctaatttttttgtatttttagtagagacagagtttcactgtgttagccaggacggtctcgatctcctgacctcgtgatccacccacctctgcctcccaaagtgctgggattacaagcatgagccaccgcacctggccgtgtgttagtttttatatctatgttagtaccgcaaaaatgtctaagaaagcagacccttctaccaacactacaatgtctcatattgcaggaggcctcatagttaggaagacaactgttagcaaagcccttgtttctctcatgagccaccagtgtctggcatatctcaatgcactcttcatgatgctctaagctctaagttaggcctatggttgcattgaagctctaagttaggcctatgattaaagtcttctggctcataatgataaaagccattattgtaggcagttagaacctgttgaaggacagagacgtgatggattacagtctgagataatgtaagttgtttaaaaaagtgaaaataaaagaaaatcaaaactttgctttacctattcatttttaaaataaccaaggcataccccttttgctgtcttaagtttcagacaagggtgcaacttctacagtcattccttggtggctttacatgctttatttgccatgggccattaggtgctatgggtgttttcatccccactttggtgctttgtcaagacatcaagcatctccatgaatatactttaatctttcccttttttgtgttttgttttttaggtaagtacttttggtattcttcttccttaatgctgaaagaaaatgcagctgcctgatgtagaacaaatggcttttgaaagcaaaatccaaaagataaaaaataatgtgaacagtaaagaatgacaccataccagatactggtaagaattttaagtggcattcaaacacccctctctttttggagagaggactaacagtacaggaagatgcggggagggtggggagggattgttgccgtgcaagtaaaaagaaaattacagacagtgttcatgaaatattcatttacacctgcttattggttagatgaacagcctttggttctgagctggctcaccattcccaggctggaaattattcacttaaatgcagcttttaaacattttcttaaaatcctcaatggaaacagatgtgcacatgctgagggaacttttttttgatctttttctagaagagggttaaattagaaaaaaaaaccagtatttttaatatttaatttcatgtgtatagctatgaagctatatacttaaatgctttgtaacatatgatcatgaatatatgtataaacttcacccagaaaaatccataaagcttttgacaataaatgtgtataatctggataaatgaaataccagtgaactcaaacataatttatttcatgttttatgtcttctctttctcattttccatgtacaattcctgtgtacatatgaaataacatacaaaatacaattgtacgtatgcttcaatggcattttgcccaaattcatagtccttttttatatggccgtggatttcgagatttaaacatatatggtaaatagtatgtttctgttaacttcagcatagcccttttagtaacaagacattgtttactataaattgagattatctatccaatgtgagtaaatatattattaaaaatacattaacatttaagatgaacaaatagcaaaggttaaaaggtttcagagaccattacctgttactaaatcatttctctctcccatttactagtcttatctcattgagtttcctgctgtcctagaatgtcatccctctgtctctgctttatttagtttttgtctatattcaactcagaccctatatcatgtacaaagctttcctcaagtctttgaacacagactggtttattcctgccctaaaatcattttttaatagaatccatgtgttaattttctgaggctgccataacaaagtgccacagactgcaagcgtaaatagtaggaattgatttactgatagttctggaggctggaagtctgaagtcaagagagcagggttggtttcttctgaggcctctctcctcagcttgtagatggctgacttctctctattccttcacggggtctttcctctgtatgtgtctgtgtccttagctcctcttataacaacgtcacatttgattagggcccacacttatgacctcaacttaatcacctcctttaaaccctgtctccaaatatagtcatattctgaggtacgaggacttcaacgtacaaattttggaggtatatgtacgaggacttcaatgtatgaattttgggtataggattcaccccgtaacagcccatgttagtttctcacttcattattctctgattcttccatgtatattggttctatcttccctaacaagttcatcaaggataaggattgatcatatttcaagttttgtttacttcattcacagttcctagagggctggcatataatattaaatgctacatatttgttgtttgaaattactggaaaaagtagcataacaggaccaaatgagagcctctttttccaattattgctgactttagctcccttatctggacagaaaaaaacagtagcagaggtttgagtcaggcagtggtcaaatgaactgtctctgctttctttctgggaggcccaacagcattctcgtcagcaggagcattctggcgaaaggaaatgctgatctctgcaaatgggcaaaagtgtaaagagcattgaacccagcctcataccacagaaaacaatttgggcttgtggaaaataattacccagtgaagagtcttctgaactagaggcaggtttttggagggggaaatcataaacacatttgtggttgcaaggtagcagattgggtgagctgaaactaaaacaaattttggtttaagaaattgtattttaagttctgaagtcatacttaattcttaataattctaattgtacacacgctaatttaaatggaagatgtttacttcattaaaatttcaacactaaaatgctggttcagtttgttgtattactttcttcaggttttgttatattctatttttcataatttctagagccagcattcaaaagtaatttctgtgcttcaaaataggatcatcctaaattcaaattatatgtaaatgtcattgaatgcagatataaacatggtgccacaattttatagaaaattctaaaaaaacaaaacaaaacagaataaccatgttgctctcgtaccaaacgtgtctttgggtgggttactaagtccacctgagtctgagattctccatctgtaaaaaaggaatcagaatacctactttgggcagttgctgatattaaatttaaataagcaaagcagttagcccagtcatgtcaaaatagttgagcccaatgaatggtctttttctttatctctcttcaggttgaattttgcacagtagataatccatctatcacagaggtgtgcagatgtgactgattcattgattgaaacattcattgccccatttaaacaatgtttaggtattattatccactgtatcctggtttcatgctggatgttgggtaaataatgatgagaagaaacagacaactccaactttaatggagaaattgacattaaaagtctaaaaatatgtataaaattttaaaaaatcagtgttgtgtagtaaatatacacagtaccaggagattttataacagggagggtatgtgtaaaatgtcaggaaatatttctcctaggatgtaacaatgaggagagtttcagagtatgcatgtgtgcacatatgtgtatgtgcacatgtatggatatgtgttccaaaagtaatagtggttaaggtggtgatggtagtggtggtgtaggtggtgatggtggtaggagaagcaagagaatgaaataaataaaaagatgagtgtctgggaacagcatgtgcaaagtcctgatgtaggaaacagtactgaatggacagtacggtttaccaagggagggctggtgaggctgagatgaagagagctaacaggaagccagtaacttgagatgaggctagagaggagagcagaggccaactggagcaaaaccttatagacatattaggtcttctaccctaagaacaatgggaagccacctaattttaagagaaagcttaatggatgtgtgtgattcagtgcagggactgctaccgctcttaatcctcgaaatatcctgctaaccaggttggctttagtgggtggaaaagtgaggcccatacatattcaaatttgtattttgaaaagattttttttttgtcctccaatgcttttgccagaatatagaaattcaaagtatgtgtatttatagcaaatacgtagatgtttttcaccttataggtgtgtttttatcacattatttttgcacatatgattcctgcatgacccgagtgaaggggtgggttgcccctccacacctgtgggtgtttctcattaggtggaacgagagacttggaaaagaaaaagacacagagacaaagtatagagaaagaaataaggggacccagggaaccagcgttcagcgtatggaggatcccgccagcctctgagttcccttagtatttattgatcattcgtgggtgtttctctgagagggggatgtgtcagggtcacaaggcaatagtggggagagggtcagcagacaaacacgtgaacaaaggtctttgcatcatagacaaggtaaagaatcaagtgctgtgcttttagatatgcatacacataaacatctcaatgctttacaaagcagtattgctgcccgcatgtcccacctccagccttaaggcggtttttccctatctcagtagatggaacgtacaatcgggttttatagtgagacattccattgcccagggaggggcaggagacagatgccttcctcttgtctcaactgcaagaggcatgccttcctcttatactaatcctcctcagcacagaccctttacgggtgtcgggctgggggacggtcaggtctttcccttcccacgaggccatatttcagactatcacatggggagaaaccttgaacaatacctggctttcctaggcagaggtccctgcagccttccgcagtttttgtgtccctgggtacttgagattagggagtggtgatgactcttaaggagcatgctgccttcaagcatctgtttaacaaagcacatcttgcacaacccttaatccattcaaccctgagtttgacacagcacatatttcagagagcacggggttgggggtaaggtcacagattaacagaatctcaaggcagaagaatttttcttagtgcagaacaaaatggagtctcctatgtctacttctttctacacagacacagtgacaatctgatctctcttgcttttccccacacccgagatcttttaatattctaacatactcttatgttctaaatcagtgacacttagaaagaaatgttgacttgaacatccaagtacaggtgctaatttgacctagcagaaacattttttaaggaaatctctctgcactgagcacttgcattatctagcaatggaaaattcaaacaatagaatgattatcataaattcctttgaatacctttgttagcagagatgaaaccttggccacctggctttaagggaaagcttaatgagcatgtgattcagtgcggggactgttacctctcttaatcctagaaacatcatgggaaccaggtttgcatcagtaatgaatttttataatgtgaatctttgattttctttcgctggtaagaaaccttatttggagatgctatgtatgtgagtttaatctcattttccattccttcttgaagctttctaggttaaccacctgaaacagtggttactataatcagtaaagatttataaccaaagtataaggaattggggaatttccatatggtgtgtcctcacaaacaaacgtcatgtttcaatatgatatgaatgcatctccatccaaattattattttaactgtatatttttccctcagtcagcaatttatgtaacacatatatttcatttcatccaactcctaataagagacccctaaattaaccttgaactatgatttacaccttctcaatatacagtcaataattgaatttaatgactaaccaaggacattttagtcattgcaactgcttacaagattatatgtaaaggattcaggaataaatagaggggtctctcagtatgaagtttaaataaatacttaatgataaaagaaaaatttgtctgcagtttttttttttacaattaactttttacaagttattatccccttaggctcattccattctgctccctttgttttgaaacactgttatgacatactactgtcagtaatggaatgtcagaaaatagtacatatgaaagacacagttcattctactgttaaatattacatcattgaagggtttaaatcctaagacgtatctttgatttaccagcccagcccaacttcctatttgctctctgctccatttagtagatttcatgctggttgctggactaaacaagtcaaacacctgcaagggccctccatctgtggccagaaaagtgttgctggtggtatatttttgatgtttaggaagaaatattgatctgcttaactaagatggtcataagataatatggggttgtactcatctgattctcacaaaaccccagggtgctcagaactatactgatgtgttggagatgctacttaggaaattagaggaccagcatgcatgtcctttggaatgatgtatgccaccctatcatctgcttggccaacaacttgagccaagacacacctggggtatcttggtactacctagagaccctagctaattttgccagggtggattggtagaatccaaggaaatagttttgcaagtgacacaattggtggatgatataataagataatgaagactaaaataatttgaagaagggaaatggagataatttaggctaagttgttctatttgctattcttagaagtgttttcttcacatttagaagaagaacaattgattataaaatcactgctttgatgcattaatttgatcattctaaacaggtgatgaatattgtcttatgttatttgcctccattacttaatctgactatcatagaatagctaagaatacttcttaagaatgagagtttgcaactaccagtcacataggccagtatctgttaacaaaatgctagtaattttgttcattaaattttaaacattaaatctattattgcattaagacctattaaaatggacaataagtaagggccagatatatcatgagtagaaggagtccctttctactgagagcctatggaaaggacaactagattccagaaaaatctgttcaacttccaggatggcatactaggagaaataaattgggggtctaaagagtaataagcaggaaaaaaatctggttttctttgaggcaatgattagttgaagcctacacaaataaaccaattacaacattttgactgaactgagaataattacactggtagtcaactcctggggaaaaattatgaagttcaggctgtaagctgtctaggcttttattaacttgcattgttcttaactgattacaggcaaaaaggtcaaaacattttggcctacctaggtagccagatggtctagagataatttcttaattaccaaatgactgtgttttatagtgtcccttaggaaaccaagttttaaaactgtgtctaaagagaacctgatttaattttttgatgtttcttttatttttgcttgattatatattataatcattttgtaaaaaaaaatccaaacactacagaaatataacttagatgtttataatcttcgcttctctcttagataactatttctaagagtttttgtatacatatttagatttttgatacatgtaaatatatataatcttttttactaaaatggtaatttacaacatgcttttaaacaaacttttttttttacctaaaatttcttagctatttatgtcagtacatgttgctctatgaagttgtaaacagaacaaagcagcgtgctccccaagaggactcttagatatttgaaagtagcccataatggtaaagtaaattcattcctgactttgcttgaggaaactaacatcctctccatcctgccttgaggacaagtgtgttccttcatggctgacacatatcttggcagagcacatgtgctgcaacagcacacagtatggggtaggaacaggatttgagtgatttactaatcaagtgttggctagaagagaggagacttgtaccaccccgaccctgcatcatgcctcttgctctcctctttagggtgaatgtaaaggggaatctgcccagttggggtacagataaaccttttggttaccagactgttggggtttagatgtcaactctttataggaattgtctaggaaagtcagctgtccaggcttggagaccttaaggaagcatggaaagctgcagctccctttttccaggaaaaggcagtcacccgtcttcttggaagctgtatttcagggaggcctctccagatgggctgggggacactgccaactgttagcatattgtccagacgacccagcatgagctatctaggtcatgttcagacagtaccactcatggtgttctcttgcttaaatcattgttcctgagtagccttgaatagtaacaaatgtgatatcttgacatcatctggtggttgggtgacaactgtttaattttctaacacagttggtttctgcaatgccttttcccaagtaatttagtattgtcttatcctgctatgtcttccacaaagggaagatgataaaatctttttaattagcataatgtttgtctactttaattttacattaaaaatttgttatacttttattaaaatactttcacagtaaagttttaatccattttcctatggatttttcattttgtaatatttctttcccatttataatcatataacatatacatttaataaaagtatatacaatatatatcaagcatatatggtatatatactataattttgtctgttttctactttctttctacttatgtctattttctgtattttttccatatggacatcatttttcacatttaatgtcttcttaacattacagggcagttctaattgttagaaggcctccttatactgatggctagtttgactcattataaagtcagttattgttcttggttttatgtcttaacaaggcatcccctcctcgaaccttagaggaattgatatctgacttcacatgctctaggggatgccatgtaaaattttgtagaaatgtttagtattctggcatgtgtgtctctaactttgtcagatgattagagatctgtgattagttaacaaccacacaggactgaattagcttccttccgtaactaaaagaattgaacagattgagtaaattaagtggatgcctcattagctccacaaagtttattagaattagagtcaaaatctaatacagggctttggactactaatatctgctagctacctttgggatgatttcagtatcataggatcatctgaccaaacaagctgtctcaaattcctgttagagtgaaaccttggctggacattagcttcacctgggtaatattaaaatactgatacctggccccagcctggagagattttgattctattaaattgccagagttagggttcaaggcaaggtacatccagagttgacaaccactggatttgaagccaaaatgtatagaatgtgaaacaggtaagcactgttggaactaccgagatagagacaaacacattccaggcactagcctctgcttctgtcttttctgatgtaagaatatttcgcctctcagaaagttgcttcccaaatgaatacttttaaaaattaacctggttttttcagtacataagacagggtaaggagaaaaagttcacctggtttttaaaaacactattgtttaaactttaacagaattatcttctcaaaatacttagaaatggagtaaatgtttctgctttgataacactgaaaccaaagctagagagtacagttaaaagggccattaaaaacagtttttattctataaaaataaattaatcatcgaatattcattataaattcaatcatgaaggaaaatacacattaaattatttatactaagataaatataaacctctattggcaaacaacttcgtagttaatttttctaatttaccactttctgcatctcatgcaaattatgtcttcttgcattgccaataaaatatgagattggggaaggatgctgcaatatccatgagaaagtttcatgtaagtgcaagcaatcagatttcattgcagatccagagtagtaacactgacagaactatgtcagttaagctttctgcattatttttatgcgttgtcattttcttttggcagaggagagattgaggatttacctggtccagaaatcgttgtaggttaacaaggtaccaatctgggtttgtttttatccccttgcttaaccaatcgtacagttaattcccaaaatgtgttattttttaacatgcaaagcagttcaacaacgatagaaggtgtagggattccagccacagacagagcctgagagaacaaacaaagcagattcagaaagcaggcaagtagcgcctactttgtttcagtggtatgtcctctgcagttcaaaatccttcagtatctcttaattaattcatagactatttccagtgaggtttcactgagaattccttaatgtcaagagctctctctgtatcttaagcagttagtgtcattgaaatttacttatgcaatgattctttcaccaaatatgtattgaaggcttatgatgtgcaagacatgtcccaagttctggtaatacaatgatgaacaaaattaatagtttctttctacacagtttttggtttatcaaatttattacatgtttaataaatgttcattaagtgcataaatagtaaaagaatcaaagatgtgatttcagcactatgtatcaaaaccacagaatggctgagtgttctttttaaatccatgtatcatagtgtattagaaggcaaaataataagaaagcagatcagaagtcaatatggtccagtaacaagaataaggagtcagattagagtcacattaacggttcacattttcctagctgtgggactgtaggtcgttattttcttgtcttattttgtctttctgtttttctttctttcttttctttttctttttttttagacagagtttcactcttgttgcccaggctggaatgcaatggcacaaactcagctcactgcaaactccgtttcctgggttcaagcgattttcctgcctcagcctcccaaagtagctgggattacaagcgcccaccaccatgcccagccatttttattttgtatttttacttgagatggggtttcaccatgttggccaggctggtcttgagcttctgacctcaggtgatccacctgcctcggcctcccaaagtgctgggattacagacgtgaattctataggtctcatttgcaccatctgcaaatgtgaacaatggtattgtgttcatttacccattcagccaacttttcctgaacatctcttaagtatagggttcagagatatggtaggttgggtttcagatgaccaaaataaagtgaatattccaataaagtgagtcacacacattttggttttccagtacatacaaaagttatgtttacactatagtctattaagtattcaatagcatgtctagaagacaacgtgcataccttaattttaaaatattgccttgctaaaaagtgcttatgatcatctgagccttcagcaagtagtaatctttttgctggtgggaagtcttgccttgacgttgatggctactgattgatcagggtggcggttgctgaaggtcagagaagctgtagcaatttcttaaaaccaggcaacaataaagtttaccacatttattgacttttctcttcataaaagacttctctgcaacatgtaatatactgtttgataggattttaccgaatgtagaactttcaaaattggagacaatcctctgaaacccaactgctgctgtatcagctaagtttatataatattttaaatcttttattgtcatttcaacaatttttatagcatctttaccattagtagatttcatcttgagaaaccactttctttgctcatctataagaagtaactgctcatctctttgttgctgagattgcagcaattcagtcacatcttcaggctccacttccaatgcttgttctcttgctatttctaccatatctgcagttaattccttcacttgaacccttcaaagttatccatgagggttggaatcaacttttctcaaactcctggtaatgttgatattttgacctcctcccatgaatcatgaatgttcttaatggcatctagaatggtgactcctatccagatttttaattttctttatccatatacatcagaagaatcactgtagaaagtagccttcccaaatgtatttcttaaataataagacttgaaatactctttgaatcatggctgcagaaagaatgttgtgttaagcataaaaacaacatgaatcttgtgtattgtattagtctgttttcatgctgttgataaagaaatacccgagactgggaagaaaaagaggtttaatggactcagctccacatggctaggaaggactcacagtcatggcggagggcaaggaggagcaagtcacatcttacatggatggcagcaagcaaagagagagcttgtgcagggaaactcccatttttaaagccatcagatcttatgagactcatttactatcaggagaatagcacaggaaagagctgcccccataattgaatcacctcccactgggtttcccccacgacacatgggaattgttggagttataattcaggatgagatttggatggggacacagccaaaccatatcattccacccctggtacctcccaaatctcatatcctcacatttcaaaaccaatcatgcctccccaacagtctcccaaagtcttaactcatttcagcattatctcaaaagtccacagtcctacatctcatctgagacaaggggagtcccttctacctatgagcctgtaaaatcaaaagtaagttagttacttcctagatacaatgggggtacaggcattgggtaaataccattccaaatggaagaaattggccaaaacaaaggggccataggccccatgcaagtccaaaatccagcagggcagtcaaatcttaaagctccaaaatgatctcctttaactccatgtctcacatttgggtcatgttaacgcaaagggtgggttcccatggtcttgggcggctccacccctgtggctctgcagggtgcagcctccttcctggctgttttcacaggctggtgttgagtgtctgctgcttttccacacatggcgcaaactgtcagtggacctaccattctggcatctggaggatggtagccctcttctaacagctccactagacagtgccctagtagggactctgtgtgggggctccaaccccacatttcccttccacagtgccatagcagaggttctccatgagggccctgccactgcagcaaacttttgcctgagcatcctggcatttccatacatcctatgaaatctaggcagaggttcccaaacctcaattcttgacttctgtgcacctgcaggctcaacaccacatggaagttgccaagcttggggtttgcaccctctgaatccatggcctgagctgtaccttggccacttttagtcacagctgaagtggctgggacacagggcaccaagtccctagcctgtacacagcatggtgaccctgggcctgacccatgaaaccatttttttcctcctaggcctccaggcctgtgatgagaggggctgccatgaagacctcagacatgctctggagacattttcctcgttgtcttggggttaacaattggttccccgttacttgtgcagatttctgcagctggcttgaatttctccacagaaaatgggattttcttttctatcgcattgtcaggctgcaaattttccaaacttttgtgctctgcttcccttataaaactgaatgcctttaacggcacccaagtcacctcttgaatgctttgctgcttagaaatttcttccaccaaataccctaagtcacctccctcaagttcaaagttccacagatctctagggcaggggtaaaatgccagcagtctgtttgctaaaacataacaagagtcacttttgctccagttcccaaaaagttcctcatctccatctgagaccacctcagcctggaccttattgttcatatcactgtcagcatttttgtcaaagccactcaacatgtctctaggaagtttcaaactttcccacattttcctgtcttcttctaagccctcctaactgttccaacctctgcctgttatccagttccaaagtcacttccacactttcaggtatcttttcggcactgcaccactctactggtaccagtttactctattagtctgttttcatgctcctgataaagacatacctgagactggggagaaaaagaggtttaataggcttacaattccacagggctggggaggcctcacaatcatggcggaaggctaggaggagcaagtcacgtcttacatggatggcggcaggcaaagagagagcttatgcagggaaacttctgtttttaaaaccatcagattttgtaagactcatttactatcatgagaatgctgcaggaaagacctgtcccccataattcaatcacctcctaccaggtttctcccacgacatgtgggaattgtgggagttacaatcaagatgagatttgggtggcgacacagccaaaccatatcatgtatccatcagaactcttggatgaccaggtgcactgtcaatgagcagtaatatatttttaaaaatctttatataagagcagtagttctcaacagtgtgcttaaaatatctagtaaatcatgctgtcaacagatgtgctgccatctaggctttgctgtttcaggcacaagcacaggcagaatagatttggtgtaattctgaatggccccaggattattagactggtaaatgaacattggcttcaacttaaagccctcagctgcattagcccctaacaagaggatcagcctgtcttttgaatctttgaagccaaacattgacttattctttctagttgtgaaagtgctaaatggcatcttcttccaataaaagtttgttttgtctacatttgaaatttgttgtttaatgtagtttcaatgatcttctggataacttcctatagctttgatatcagcacttgctgcttcactttgcatttttgtgttgtggagatggcattttccttaaacctcatgagacagtctctgctggcttcaaccttttcttctgcagcttcctcatctctatcaatctttatagaattgaagagagttaaggccttgttctgaattaggcttttcttaagggaatgttgtggctggtttgatcttctatccagactactcaaactttctccacttcagcaacaaggctgtttcaatttcttatcatttgtattcactggagtagcactttttatttccttcaagaatattacttttgcattcacaacttggctgtttggtacaagaggcctagctttctgtctgtcttgacttttgacatgccttactaagcaagcttaatcttttctagctttttatttaaagtaagagatgtgctgctcttcacctcacttgaacacttagaggtcattgtattaattgacctaatctcaatattgctgtgtctcagggatggggaggactgaggagaaagagagagatagggaatggccagttggtggagcagtcagaacacccattaattgagtttgccatcttatataggcatggcttatggtactcctaaacaattacaatagtaacatcaacaatcagcaattacagatcaccataataggtattaaaataattttaaaagtttgaaatattgcaagaattatcaaaatgtgatacagagacatgaagtgagcacatgctgttagaaaaatggtacccatagacttgctctacacaaggttgccacaaaccattttgttaaaaaaaaaaaaaaagccatctctgcaaagcacaacaaaacaaagcacaataaaatgagatatgcctgtttcagtcactttgctatttaaaagagaaaatctgttaagccatagtccttgtcctcatgattcttacagtttggactggaagaaaatctttaggagtaaagacattaaatgtgatgaatgtttttgtgttggccttttacctatttattctcagaccacatattgccctttctctgccctttatagttggaggctacgctctgaaggctgtggtctcaagacttccatgtcctttgttagatagatgtagcacattggaggcactggtggacatttggggagaggcagaaagagagaagccagagtgttttactctctctacctgaggcagcacctcaggcagtagctgtgtctcctccatggcttcacccttagctaggtgaccctaatccttgcatacatcagccctcctttttagctctagtccaggggcggtagttgcttcctgttgtttctaacccctaagttgcctcacagtcccctatttggcatttcaactcttccatcaccagtgcaatgaatcagatctattaaatacactacttttaaaatgcatagagtgtttcttttagcttagtcggaagctgtttgataaagccttgataggagtggcagaggcggatcttatgttagaagtagtcaatgaaggtttactgagaaagtaaaatttaggctaaaacctcaagtgtgaatataaatgtatcaatggagaggggaagaatattctagatcagaagtgtccaatcttctgtcttccctgggccacaatggaagaattgtcttgggctacacagaaaatacactaacaatagctgatgaactaaaaaaaagaatcacaaacaaaaaatctcaatgttttaagaaagtttaccagtttgtgttgggccacattcaaggccgtcctgggcctcatggattggacaaggtttttctagatcatgtgcaatgggaaggaaaatgaggcatattttagaaactaaagatgtagacaactggaatgtgacatacaagagaaagaaggtcaagaatgtttgagggctgtcaagctcattggaagacattacagtggaatgacatgggcatttgtgttttttaaagtcagtggctgcattgtatagaattacttgggatgcaagcagggaaccatttagaagattattacagacagcggtgttggtatggagcagaatgatagcagaggcaatggaggaaagtgagcttatctgagagatagaggtaggaggtggagtctgcatgtcttggtaattgagagactctgtgaaacaagattgaggaaagggttaggattattttcaggattcaaaacagagcaactgggtagctgaggttctaatcacagtgagaaggaatattggagaaggaagagttccatggttgaacttcaggtatatgtcggttatccccagggagagctgtccaggagtcaggtgcgctgtatgtgtctggagctcaggaggcagatgcagaccaaagaaattgatggggagctatccatctacagatggtcatagaagttatttgagtcaataaaatcaactaaagggggtgcaagattaggagaacaagagagtcctgtctcaagcctaagaactgccaatatttgaagacaaagctgaaatgaaagacatgaacagagacttaagaagaaaaccaagaaagttaggtgctatggaagccaaaggaaaggagtgtttcagaaaggagggagtggccaatagcttcagaaatgttcattggtttagtgaaacacaagtcagttggtgacccaatgggagaaatttccatatagtaggagcataaaccagattgaagtgggttgaggtgtaagtacaaagggagaatcaagatagtgaatataaacaaaattatttcaagaaattatgctcagagtgaggaggaggtaagaagtatctggatagggaagtaggaattgagagggatcttattttgtacagtgaaaaataagtgcttatggaaaagatttggtaaagaggaggaaaagagtaagggaaaaatggatgaagctgcgtatcagagaatgtgagaaggacaaagaaccaaagcacaggtggaaggatttgcccgagttggtaacaggagggaaaatggaaatgatgactgtgggagtagatgtgtttgtcattttgatggctggacatggagaatgttcctttttgatggttactattttctctttgagtaggaatatcatctgctgtgtgtgggaagtggggactcaagtatttgagaagaaagaagaaggacgtttgctgtagtctttgcagaaaatgaaagtgatttgattaatagttgttagaatttaaaaatgtgtgcacagtgtttgggttaaagttgtttttaaaaaaccagccaccttgccttttattctttatgctgtgaaacctctttagagcactcagtcaccttttggccactagatggacacagtgtactcagtgctaaactgctgacccaccaggttccttttgttaccagccaatactgacagagtgattgagttgtgaacttattgttatgaattgaaacttattttagagaaaaaatcttaaataacacattccatcttacttatagttcataggtcagagaaagactgtggtgctacaaaaacattagccaatatattatttgctttcacgctaagtgtaatgtgtgtaacatgctatctctttgaaattttttgccttaaaaatgctaatcagttggcacaaggcgatcatttacatagtcagaatagagcttttggtttagcattttatcttaaaataaggcagaaatggcattgctctggatgtcagtatggtgcattataacccaagtggtggaaaaataactgctaaatggcaaacacatagaaactgaattctgctagtcagcttccatttggtagagatatgtgtgcccttgggtagctgcaatgttagctattattaatagttcaaatctttgcttcataaaagttctgcatatagtgttgtacaaattgaagtgattcaaggaaatcatagttctgtggagcttcctccctgttttgtagtggagattgggaatgggggtggaccataaagtaggtggttttttttttcctgccactcttaactaattacacaccctgccatatcccccaccaacataagacttcagactgagaaaacctacataatttaaccaatgttagaatataggcatttttaacgtgctgaaaacagtgttgttcttttggttcctaaactaaaatcatttgatacatttctctgtcctatgaaggaagccatgaatgctatgagtaaagatatttgtggcaggtaagaagagggagttaagtaagggagtttaatatgaaaaattcatataaaggctccaaggttaaataaggaatacttttgcacaatgggttcaaggttttactgggtagagcatttttaaagttttataacgacgttagaaggaatcgatttgggagaaaaactatatctgcttaatgtgagggagcactgtggaaaatttccagcacaaacttttcctgggcctcaacatttcttggtaatgaacctagatttggagtgatcaaataatttgctgtctcaagtagtaaaagggggactattactaacttcacaagaagacaggcataaacccagcaacatgtacaaagcaggatgatctcaggtaactcaggaagatgctggaacactctgggtgaagggcattaatgctgttcacagtggaacacaggactgctaatggtatttttatgcttttatgcatcaaaagcattgttctttgatttgtaatctctcacatatgtgaagcagggcctttcaatctggatttggggtcagaagacaacatgtggatgggaggcagaaaattataacagactcacctggggagcagttttttgttgttgttgatattccctagctgctgggaatggtggctcactcctgtaatcccagtgctttgggaggccaaggcgggaggatcacttgagcccagaagttcaagactagcctaggcaacttagcaagaccccatctctacaaaatttaaaaaaatattagctgggcatggtggcatacacctgtagtatcagctactcaggaggctgaaatgggaggatcgtgtgagtcctgaagtcaaggttgcagcgattgtgccactgcactctagcctggatgtccttccacctcccccgccaaaaagggatattccaaaactacaacattctactacattattctacattcttcctttttactctccatattgatacagaaacaaaacaaaacacatttgagacttaccactgcaaaagagtgttctttgaattgtggctgcaattatttctgttgcaaactttagtgtattattgttataatgatacttgaagtaatacccagatgtattgaaaattcaaaagacttcattgccagctcaacctgcactctcaagcactgcttactaagggagtaacaatgggaagagacaggtgtgagaacagaccccagagccagggaaatgaacatggagaagggaaataggcaaaatctcctcatcagtgtggttgagggaatattggggcatggcatggagagtcccacctcacttggcagccagagaatcttaaagcttattgtcaaaaaccttatgaaaggttagagaaggtaccattttattttacaaaatactttagcctttaccagctcaacatccgtgtgtcagcctgctttgaataaagaaatacacgtcttcttaaaatctgcccctgactacgatgagcttctttgtttcagcttattttgactaattaggctgaggttacaaaccaccctgatatttcagttgctacagccacagtcttatttcttgctctcattacttgttcttggctggatgatattgatatgttcgttttgttctggaaccaaccctaaatgagctgcccatcctgagaaggcagaagaaattgggagatggcaggggcacacagtgattttttaaaacttctgtttagaaatgccacagatctcttccatgcacatgccattggccaaagtgggttgcaagatcagcttggtgtcagtggggcaggaagtataatcctggcacaataatgggcttggaaagctgttaaacatttttacaataacacaatcagattctttcaaattaattacaaaagtacttaaagttttttacatacattctgtgcactgtcccaaagctatatctaatgttacttcctcattccgatgaattactattccttttcttcttagctgtgtttaaaagcccatacatctatcctgtgataatttgtacactgtattgtgcttggtttacttgtctctctccttccctcagtggtgggcccttggagggcaggagcaatgtgatattcatccatgagacccaagtgtgtgattggtgcacaatggacaccctaaaaagtgtttattgataattaatgaattaatagctaaatgagggagtgttttctttaccttccctacactcaccttttctccattccagcaagcaatcttgcacatggagtagaaatcacagtggaatcttgaagaataactagaaggttaccagatgagaaagtacagggaggtaaatcagggaagaacagctgatagattcagttgtagccatgttgagtgaaggtaagattcttggattttgcttcatgaactcgaaagtctacataacatcaatcttggccactgccaagtctgacccatctcacagcaccagaggattggggtagtaaactgcagatgtagcacccacaggctgaccagtctgaccctcattaggttccccaaaaatcaaatctctaatgcacctgcatggatgctgcaaaggaatgtgcactaaaggaatgtgaaagcgataactatttttcattatttctgatgagacattttagcaattatgttaaaatctgcacaaccaaaaagtctaaacagagcgtgaacctctgacattgactctggaaattacacacattttgttttactattttaaaaacacacatgaaccgaagagaaaagaggcagaaagactggctagaacacagcagaacttacccattaatgtaatggagtttgagcctttctcaatgatgcctgtggggagctccgtactagtaatatctcaaggatattgccattgttcaaacatttcagggattcccctcttgaacttaccttcaaaagagcctttgctacatgtttttgaaattcattgatgacaaatctccatctgttgaaggtttatctagttctatgaagctgccaaaagtcctttggcattaagcctgatgattaaagttgatgatccagttagcgaatgctattttgagtcaaaatgagaagtaactataaaattaagaggcagttttcttatgcacactggaagtgccctgtaatgataattcccaaagagaatgtcaaaaatgtctttaatcctaatagaattcactatatttttttcattgaaataaatatttaggaaacattggtttgaatttgcatatggtatacatgtttgaagaatcactcttgttactatataggtaacacttataagtgttaaaattatcaagttacttaagtacttataatgaatataaataaaatgatccattgatatttgtctatatatttttatacataaaagattgtatatgttatataatatatgtgtatacatatagcacaatgaccaaattaaattgtctttgcagctatttttaattaaaacattttcacattacgctttcttaaacaattgcctctgttatatcagaagccaaaactggcaaattatattagctcagttatttagttactggggactctatctttaaaccaaccatgggaattcatttatagctactcaacactcaggtatgtatgaccatggggcagacaaaagactgctttaaaaatcactgatgtgtatcatgctttttcttcttctttagtatttctagccatcaaaaagaaattatattgtgaggcagatggcagtaatatatttttcaaaagtgaattatatcctgtttccccatataggtaggtaaataaataaataaataaattctatataagcaacatgacataattcccagactatgaatttctgctaatctgaagcatttgattaagactggatttaaactatgcttacaagttgccggaaactactcaaaaaggctacattctgttaactgtgttatttttgtctgtattatgtcaaataattttgactaaatcattggtattatcaaggtcatgtagaagtcttcttaaattctgattaaataatcgactttctttacaactacagacaaattgcaacagaatctgtattttcaggcagttcagcctgcatagggtcaatttaataccatataaatgttgggaacagaattatcagaaacttcagatatgtcaccataagccagatgaacaatatatgtcagtaccattgggggagtatttgccagcataaactggatatgtttcttgaatgcatgaaaaatgtggtactgaatgattcttccttcactaaaattgacttatttatcttgatttaaatataggcatacattggtaaataaaacctaggttttttcataatatattagagaatttttgatacataacaaatgaggtaattccagatcgattggaattcaggtttagtgcttcgtaaagagttgaaaatagttcctggtaggtaagtaaattgtggtgggaaggacaggacattctctaaaagtgcttggttttagagatgttttggttaagagtttgaccaggtggtagcagatttactttttcctaactcagttttacttgaaaggccttcagattaaatacttacagaaccaggaagaaatgtatctgagttacagaacttgaatggggattgtcaaactggagaatgcttgccccatctgaaggagatagctggcaatatgtagggaggggaactctaggtatttttgtttgtttgtttgtttgtttttgaggcggactctcgctgtcacccaggctggagtgcagtggggcgatctcggctcactgcaagctccgcctcccaggttcatgccattctcctgcctcagcctccggagtagctgggactacaggcacctgacatcacgcccggctaattttttgtgtttttagtagagacggggtttcaccgtgttagccaggatggtctcgttctcctgacctcgtgatccgcccgcctcggcctcccaaagtgctgagattacaggcgtgagccaccgcgcccgactgggaactgaaggttttaaacctcctaaacattcaaaagaagcccaaatctcaactttaatgtgacattttctgtgtgctttaaatgttggatcaaaaggaaaaacaaaattaaaaatatgttggacaaactcaggcctgctgtccatatttgatccaaggaggaccaatttacccactctatcctacacctttcaggtcatagcattttcctttgttatctttcggcattaatgtcatattccaatttttccatatctatgagcaaggcccaaggtctgtagccaagcccagggtttgcatgtgatatctttagaaaaaccccagagaagctttctcttgttttctcactatgctgtaagtatgaatagcccaaagcaaaaaagacaagtaccctgactatcatgatcttctaagtattcatggagctcgctaaaattatagttccctgtgaagagcgtgtcgttgcagaaaagcactggagagtgggcttagataccttcctgtttgatctcaatagtttaatgtttactagctcactgagaagagactgccaccttagtgttaccctcttgtaccaccctaaacaagtcatttatttctcttgttttctctctttaaaaaaatttccatatgaaattctgtgattttttttcccctcattacctattttctatcatcattgtatccaaaaggtcaagagagagaaaaggccacttctccattgactggttatctcttagactgtatgacagcaaaaatataagcaagggttaaatttcaaatgcatccactctgctcatacacatttgtgatttaaaaaacacacttcattgaataatttaaaatatggttgtaccatctgttcttgtggggattaacattgttcatgatggcaaaataatcacgttaaataaattctagatactgcactcttattattaataatagcaatgatattgttagttcagatgacccggccttttctgtctccatataatcacactattgattttccagtattggaaaggagaacgagagagtacatgcttttatttctaaatggaacatgctgttcaggaattctgccatttcttttatggaaataaaaaataaagtgcaaacatatgccatctttgaaggtaacattatgtaagcctttgagtataacatttgctgtctttatctatttctttgtgtctattcataagaaaaatgatcagattgtcaaattcatattctagaaactacgcaatcaattttttttcaggcattctgtcgtctgcctggaatgagattagcaaaagagtcgttgtgtaaactgaattagtttacttcatgcgagcattgattttacattccctgaactcttataacattttatgtttgagccacacagtaggtactatctcacattgactgagaatttattgtgtttaagtcatttcttctaaaaagtattgtaagctttgtgaggacaggggccattttatttttctcttgtatctgttgaaatttcccactctgctgggtttttctaaggtcaaaataaattagaattaagtgattgactttttaatgttgtatagtggtgggaaaaggttaaaaagagttgcttttcgtagcaagatggtatgggccaatgacttctaccaacaactaattcggtgatataaatgatatactcttagcttgggcttttcctctgtgaacttctatggcaattgggtgtggacaaatgggtccttgaagatattttgaaaatttccccaacaagaacccagtgcttaatgaccctctactgccaggtaaccttcctaggttgctgcacctattccctctgcttttctttaaaatcacatacttttatatttcctaagagaaggtagaatgtaataggcatcattaatttttgcagaaagtctccaaaacatgttgttaaatcaccgctgtcttcttacctccaggcaaaaaggtaccaacttatttaaatatttgttcactcacattatgtgctcctgtgaattttctctgggtgtcactcttcacagtgagtatgagctctcatttaatctctttcaagggaaaatgagctcaaagaccctgatgttgcaacttgacctccttgagtttgtattaagctgttaacttgctgatttgtccctagtttatctattatgaaaacttggatgttgtcaaaccacattttcattccccagtctgtgttcactatttgatgttccccacaagttacactgccttggtctcaactaaattggttttctatattacaaagtcaatttaatatctgaatgatcttccaagatactgcctataatttcttttacttctctctcacaaagccttatctttcattaataaaaaatggtcccaaagcccattgttatcatttgcatttcccactttacacaaaactagccataatctcactatcacttgtctggtaactcaggaatatgctgtataaatagtgtattttttattttggtaaaatatttgcaaaagtatcttgtggtagctataatggatgtgtgaattggataaaaatactattaagtgtgttttttcctagttgaacaacatagataaagaatactgagtaaagactaaatatttgcctggatggaagaccgttcatccaatcaaacaaatatacagaaacataaagagatagtaaatacactggaatgcaaagtcagagtcaatagttatttaagcttgctaataaaaatgactgcaatttcaagtgcacagttaattagaattggatggtagaggcccaagggtgatggcatgtaaatgaagaatatgtgaggaattctgtcttaagccttattcatagatgtacagcagagaaattaagctgactgacattctgtgccctgcaatcgtcatatcacacctggggtgtgggattcatttcagataccacaggttaagaggaaatcaacaaggagcaatcagtccagaagggtgttgccaggatggtgaagcatctgggaatcatgatgtcttcggaactgccaaaagaaccgagactgatgtggcctggaaaagggagagaataaaaactcctgtttagataatctgaggttttcatattaaaaagattcagggccaggtgcagtggctcacgcctgtaatcgcagcactttgggaggccaaggcaggtgtatcgctggagtccaggagttcaggaccagcctgggcaacatggtgaatcactgtctctcctaaaaatttttaaaaaattagcttgtgcagtggcccatacctgtaattccagctactcaggaggctgagctgggaggattgctggagcccaggctgtggaggctgcaatgagccgagatcacactactgcacttctgcctgggtgacagagtgagaccctgcttctaaataaataaataagactcaggcttgtttttgaatgactatgatcaaagaatagcacttttagaaaggtgaaatttagtttgatacaaagaacttttcaatatttaaatcttcaaacttttcaatatttaaattttcgatatttaaatctgctcaaagataagcatttaaatctgctcaaagataagcataccatgaagcagggctcctcatgccagaaccagatatttgtttttccttcaaggctgttcatgcattaggggaagactgaatttcccatggcttctaatgaaccttttaactatgaggatctgttacatgaaaattttttttttcaagatggagtttcgcatttgttgcccaggctggagtgcagtggtgcaacctcggctcaccacaacctccgcctcccaggttcaagcaattctcctgcctcagcctcctgaatagctggcattagaggcatacaccactatgcacagctaattttgtattttcagtagagatggggtttccccatgttggtcaggatggtcttgaactcccaacctcagatgatctgcccgcctcagcctccccaagtgctgggattataggtgtgagccaccgcgaccagtgttacatgaaaaattcttagaatagtgcttgatggcaccaagtaaatgttcaatagatattagttgtaattgttatcagtagtgactattctatgcatttgtaactgattattttttggatgggaataagtaaaggtgtttaaaatgttagcaccggtttctgttgctaaataattaaggtagttagtaaggtcttaggctacttgtaactaatttactcttaatttgtcaccactttatgttttccattattgcctttacattctatgttacctagatttgggattaattcatcaaatttaatatgaaaactttaagtgactgctaaatcacaattgcatatattaaattatctagtgataacgtagcaatagtctatcaagaaaggaatgaatcatgaccgaaaaaatgaatctctttcattaattaagagagatgtttcagtttagaaacttacagaatcttaatggttaagctctaggtgacgttagcttcattggattattttctcaggtgacagatttgctacatcttaggatggcagctaatatctattgaaggtattcattcattcactcacttcctaatttatttaacaagcagtgtaccaaccactgcccatgcctgcacctagctgcttacctctacagagtgttttctacccttttatccctttttgagtcagtcatcacaggaagaccagcctctcagtcatcctatgtcccctatatcccaaccccaagggctccatggcagcaaagcagtccctcttctcaccccatccctgaactccttgggctccttccctgctgtattttcctctgtatcagttatcatttctcttatatattttacttactatgtccatttacctatctctactggaatgtcagctccataaaggcaggaatatttgcatgtgttctatttgctactgggtacccagagcctagaatagtaacttgataaatatttgttgaatgagtgaataaggcctaagtgtcatggaaactgataccagaaaggtgttatttcttccccagggttaccgaagccatttatggcagcgcagcattgtgacccaaagtcacttggctctgaaaccaacatccccattcttttttttttttttttttttgacagagtcttgctctgtcacccaggttggagtgcagtggcacgatcttcactcactgcaacctctggctcccagggttcaagcaattctcctgcctcagcctccgaggtagctgggattacaggtgtgtgccaccatgcacagctaatttttgtatttttggtagagacgaggtttcaccatggtggtcaagctggtctcgaattcctgacctcaagtaatccacccacgtcggcttcccaaagtgctgggattacagatgtgagccactgcacccagccccaacatattcattcttgatctctccctgcaagcaaataactttgaaattatgctgaataaactcagggatctagagatatttgacaatgacaatgatatttcactgctgtatggatttaaatacaaggagacaacttttgtatcatttacatttaggagaacattcaggtcaatatttgcctgcctaatttatctccatgtggatcacttttgtttcttttctagatgtattcaatctgatttagtttattatgagtttctctattatttgtttttttttccttggatcattgatgcagaccctagaagaggtggagtacagaaatagatttggagaagcaataatgagtaagcctcagtctttgcctctgagatgcattcagaagtggttgaggcaacattgtaagtgtgcagttccagagccagaagataaccagataatttataatccaagcaataatattgcaaaagtaaaaggaggcactatttaatcatcattccagggcaatagctgtatactattcagacaaactgaagagtaaagtcccctagtttaaaaactcgacaaacgtaaaatatgcttgcacatctttttagtaataaatatttaccttgcatctactattttcagagacacatactaggcactgtagcaatatatatagaacagtgtacagggcactgtggtgaatttaaagacaagtcatatatcttcctatcttgtggttcagaattcactttaggacagagaacattaaaaatacaataaaaagcagtaaatgatggtgcaagctgaattaagcttgatgtgatgttagccagccacaaggtttccaacagaattactgatatgatttggctgtgtacccacccatatctcatcttgaatcctagttcccattgaattatagttcatttctataattcctatagttccaattttatagttcagccaacaatccccatgtgttgtgggagggacccggtgggaggtaactgaatcataggagcagtttcccccatgcagctgtcgtgatagtgagtttctcatgagatctgctggttttataagcttctagtgtttcccctgctggcactcattctctctcctgccaccctgtgaagaggtgccttctgccatgattgtaagtttcctgaggcttccccagccatgcaaaactgtgagtcaattaaacctcttttctttataaattacccagtctcaggcatttcttcatagcagcatgagaacagactaatacgctgatgctgtaccacttttatttctatctcataatattgtcaattgaaatcagtcctgtcttgatgcatgaattgcacatcaaatgaattgtatgctttttttttttcctagataggagttatgccatctacttcttgtgtgtatacatagtacatgctcaattaatgctggctggctggttggggtagaaaaatgaattgatagatttaaaaaagtcatctggcaaccaaatatagagccttgtttgccaaagacccctcctctttgctgaactagctagttgacagagtaagaacttgcagcatgattattttttatcttacaactttataatgatacatttggttatttggaaataagtttaaagtgttttaattctttccactggttcctactgttggaaattcttttgcagctgaatattggcaaccgtttgtatcttggcaagtagactatgctttttaaggatgaaagtgtgggaagtagtataggacatctgtcgaagaagtcatgttgtcaaagcctgttgtgtatattaaactcatttgtttccatttctatacattctaaagcaaaatgccactccatttaacattcaaacagcttataaagagcttggaaatatgaattgtgtgggcctacctgaaatttcaatgaatgagcatcattttattcagttggttttgttgctgctttagctcagcctaaactttggatatataataggtttgttgagataagattaccagtagctaagggcttttgttggatgggagaattgaaaccagcataatttccggtacctgttaaatggcacttggaccaggcctaatttactgtccttgtatttaacaaagcagaacaaacaaaacttacttagatacctgattcactaacttcctcttctaaggtatccgtccatgtggttttctcctttacttaagtaggtttaataaacttgcctttatgtgaccaacgggtttctgttgggttttggaggcaatgacagttaatagtaaaataatattttgagagaaaccgctctcaaagaggctccattagctggagaataaagcatttttaaaaagatgagaccttatgcttcattcatctcaaacttacctgcttataaaaacaaaacagttgattgatttgatcaaaagttatccttgttataaaattaagtgggcctgctgactagctgatttatgggattttatgttctttaacttcgaagaagacatacaattcagtctcaacagtttttacaatctgagagattaggtcatgctaataaaatttctgagaaactacttatccatctgaatgttaacatcttttactagaatagtatgtttgtttcagttgatgaagacttttgtttggatgtaagctttcaactcatttagataaataccaaggaagtttttcaatatcattattttaatggattcatgatattcacattgattggctattccttattttaagtagttgggcattaaagatatttacatctttttattattttgtaagacactgtgatgaccttcatgatagttaaatcttcatttgcactgttatttccttctgactgtagccattgtgtgtaagactgcaaagtgtaatatatgcagtgtttaagagtagattaacaagaaaagctaatgtatgaacataagtagctgacccttaatagaagagtgtttaattaattttgaatttgccagtacactctcaaaacacagagcttgattaaataatggcattatactgagcttattcaagtatttggataacttttctttactgaactgaaactgatagcccaggcaggcacatctccaacacctctaattaaaatccacattcatcccttgcttcctgagaaaagatgttgctctcatgttcctttgggcactctttgcaaagtatttctgtttgattgcatatgatgaatagctccactacttccaatgtatttcagttgtcaaatatttataattattattcttgggaaagtaactgagaagggagttcaggaaagacttggacagttctttggagcatcaggaccttacaatttcagctatcttgttcaataagcaaatgttgttttaggttcctggattacaaggtcaaagaaggcagaattcctgccctcaagaaaagtcatggggaagagttgtaaatgcatgaacagctatgaaacagtgtggtaaagtcatgtgagttggcaaaatagatgagaggcttctaagtaaaactgaggaatgaagaatgttttttggaagagattacgcttaaaaggaattagccagccagagaagaaagagaaaaatgttcttgccagagtacctatcatttgggaagccccagtgggccagaagaacagactgtgtacaggaaagacactaccaagtgttatttgtggctgatacaggagaggaagggagagcaaaacaatagagcatctctgtgctgagtattggaatttaaattttgaacttcattactaaataatgtggaactattggataatttcaagcaaaggactcacatgttcatgtccttgcatgagtttgctaagatttccattttaagataatcttggtaggtaagtgaaggatagatttgaggaggaaaaaatggaaatattaactctaggcaaaacatagggggaaagataattgagagagattaaagaatgtgtagagaggtagaagatatagtctggtctctggaatcagatgaattggttcctaactctgactccaccacttaacactctatgtgaccttgggtatatatcttatccctcagtgtcttgtttttctcatctgaaaaatgagtataataatagggcccaactcatattttatgagaattagtcaacctgccaaccacagtgcctagcacattgaatgcatctgatcagtgttagctattatctattgactattaatattattgttactatcaatagtattcatgtctctagggtttgtgacctgattagcagttattgtctggttattggctgaatggtggccagtactagggaatataagaagaaatgtggggagagggagtggaggaggggaggaacacagttgatttgaattacattataaatgctcaaatgaactagctatggaacttacaagtggaattttctcatgtgcagctgatggtaacagcagaaaaatgtgaactctgaataaagaggtgggagtttttcagcacataaagaatatttaaagccaattcattggatgcattgaccagtaagtgtagagatcaaaatcaagaacaactccaagaattgagagcagatgcaaaccccaatttttgtgggtctccagtccaggtatgagcagaaaacacgagggttggggagggaaggagtcttccaagccataagccaggggaaatcgttcagtcaattcttatgctctgatgtggtcattaacagatgataacctcatcctaaagatgagacttctttaggaacatcctaaagatgagacttctttaggaacatcctaaagatgagacttctttaggaacatcctaaagatgagacttctttaggaacatcctaaagatgagacttctttaggaacatcctaaagatgagacttctttaggaacatcctaaagatgagacttctttaggaacatcctaaagatgagacttctttaggaacatcctaaagatgagacttctttaggaacatcctaaagatgagacttctttaggaacatcctaaagatgagacttctttaggaacatcctaaagaagttcctccagcatttaaaattgctaaacgtaggccagggtagagttaaaggctgaaagaaccttaattaatatgtattattccagttattagaagaaaagtcctatggattgaaattgctgcttgctggcaattacttttaattgctgtgcagggcattattaacgttgcaacgtctagcatagtgatgaaaattgatgttccagatgctttcatgtgagttctccttttcttttaatgttctcaagagcatagaatcatggggatgataagtgagatttttgctagactctatacctgtcttccatagaaatcccagtatgcaaaaacaaacaaaacatagatgggtaatcatggccattccttaataagatttgagccttatttggaggtaggcctggtatggatggtagctctaatctttagatgaaattaaactctccaatgtgttcttattttcctaaagatcaagtccccaactacctctctccagccccagagaaagggaattgttgacgatagaaagattccattttcttcccttaagggccacctcctgctagttggccagagttctcacagactctgaattcttggcaggctggagtttaacagtaatcctctctcatccaaatttaagtacaggtaatccccaggagcccctgccaggcttttggtaaataattacctgggtacaagcaaaaatgcccctgctaagaaaactctggaattttacccatcataggacacataggtctctaccatagaggtttatatcttattcttcaatttctgattgttacccctcctaggaaattcttatgtgaagcaaatcttattctcttctactgggcaatctcctaaattagctggcatgtgaaaatgcttcattgagcttttgttcttcagactctcaaatgaaggagtatgtccaaagagcctctttatgcaaaatctacaaattacaccccagtcatacatcacaattagttggcagtcattaggcattacatccatattgtaaaattagtgatgtttctcccaaattatgaaatattattcccattaagaaaaatatactgaagagtaaaaacataacagaatttttgctatatttattctcttcataattatgcaaattaataaaaattatttactatttactaactttgcattgagtgttctctcattctgatgagactccagacttctgccttttgtacacctgtgcaaagcctttctaagctgtttatttatgtcccaatatatatttcagttcagaaaggctgttcttacttttgcgacaccttaatagtagttttatttcatcaaggaactgtatgcaatcactggatatttcagagagctgcctaccttattttcatactataaagaaataaacttgaataacaatggatagtcttggcaggagtgtggaggagttgacatcttccaacatgactgtgggaatatgaactgccatagcctattaaagggaaaaatgttcacaatttgtaagctagcaatccattttcagaaatacaagcaccaatcagtaagaatatattagcaaatgtgtttattgtttatatgagtccaaaattatatgtccgtcaataaaggactcattgaataaataatggtacatttatgccatggaatcttatataactattgaaaagaactcactaggtctctgtgcattcacaaaaataattttttcatgattgacttaatattaataaaggattatacatagtatgagcccactttattcaaaaaggaaggagaatccctatacatgtgtgagggtttgtgtattgtgtgtggtatatttatatttgtataaataaaaagtttgctgtcttttccctcccattaatcctaccaaggaagggaaaagacagcaatcttttttatcttcacatttctgtgtcatttggcatgttaaaaaaatagcatgtataattttgtaattgaaacctaaaatataagaaagaaaattattgaatagaaatggtaaatactatgcagccataaaaaagaatgagagcgtgtcttttgcagggacatggatggaactggaggctattatccttagcaaactaacacaagaacagaaaaccaaatgccacatgatctcacttacaagtgggagataaatgatgagaactcatgaacacaaggaaggacacagaccctggggtctacttgagggtgaaggtgggaggagggagagaagcagaaaaggtaactattgggtactgggtttaatatctggatgatgaaataatctgtacaacaaacccccatggcacaagtttacctatgtaacaaaccttcacatctacccccaaacctaaaatacaagatttaaaaaaaaggaaaattatctactctttcaaacttaaaatttctggattttaacagtgtctgctgtttaaacccaaacagtgtctgaatttggctactgaagaataaaatgtagccctttttcagcacactgtatgtttacccaggtcccaggatgcttaaataaactggcgtgtctattcaaatcctggataagaaataatttttcaaaataaaaattatctcacagaatactctgaacacctgctactctcattaccctgaacacttgtggttttgttgctataactctagcaaatggcataaaggctagaaaaactgtgggataaagatacagcatttctctaagaccctgctgccttcagtagaattatttaatatcctttctaatttctccaacttatttttcactgttatgaaaaaacagcttacaaagaattagtaacattcactatcaatgattccatagatcttcgttcaaagtgcaggtagaaggtgcatttctcaaagagtgttttaaacgaggaaaaaaaatgtgtatcatcatcaacgttttagtgaataaagacattgcttaccgtttttatgttcctgagaggctaagttcagttctatcatgaatagtaatttatgaataagaacccacaatttttttaccagagaattggaaaaccgcccataacatttccatatacccatctcattttctaagtatctataacagtttagtgaacaatattccctcttcgaaaatatagcaaataattatttccttcctatcagatatgcatgctttgtttacaggtaaataactctgattaccaaactactattacattaggttgatgttcttttcaacgttagacaaaaatggataaaaccttgctgcctactcagagatttggtctgagtggaaataggcttttgtggagctacagaatttctgctttatctactcagccaataattggtcagagcatgagcctggttagaaataagcaaaaagcttcttgtatccatgaacagaatgaacagaaaacaaggtagtacatttagcctccgagaaacacgcgtttacttttgaagcaaagaagcaccgggcaaccagtgagcagcatatgtctgaaatctattatctgacatgttctttccagccttcccaggaatgctggtctgactactcagatttgcttttacttcttgccttttggatataatgagtttgccaagcagctgtgagtacctgactctggggaaggtggctagattccgaagcgcttatgttcatggatcaccatacgcgatcaacatgccaattgatattaagccacagaggagacggtaactgctttcctttcctctagttgtttgtcagtgaaaatgtgttttgttgccctttggtaactgctttggatgtctgctgaaatgggagggtcagggtgagaagttagtttttattcaacacactggatagttgggaaaaaaattaaccagagaggaaagctggaaatagtttagctatttagcaaaagctgatctggtttcaaggtctgtagattttaagaatttgagagattgtcagtgcttgtattgccatcaaaatcacccatgatgagaatttgaaagaggatttagccaaataatggatatatttattgatggctatatggctgtttataccagatgcccagtaactcataatctacatgtgacattccttaatgcatcataacacattaatgcaataaatgagttataattctacaaaaacatttgttttcctgtagttgctagggagggaagaacaaggttatgtatttttcctataaaaaagttgtcattttagatctgtgttctacccccgacccaccctttttatgtagtatcagaatagcgatgatatagttaactaatatgtccaaaagtcacccctcaattttggttttatacaacgtcattttcttcagcaattaacaatgaacttcagaagcatttataaagatgttccattctctctgtgaaaattccatttctccctaattttatgaatccacataatgaaaatccaaaattctaaaagcaatgtattttacttggaaactgtcattactatcttactcttctacttttctttttctaattatatctacacaaactcacaaagcatgcattttgccagatttcaccttattataaacatgaagggatgtttaagtgattaaaaagtttctaaaccttcagaaagctttctgatttttgtgagacaatattttattcttttctccagagtatcaaggcttttctgtccagctctatcactatttgactttatgaccggctagcagcaccaagcaactattttaaaatacattcagaaaagtgtgtcctaagacacccaacatggctcagttgctgtcagttacctcattcccttctttagttggtgggacgatactacaaatccatacaagttgcaaaatccacatgaatatctaatgtccctgttcatattaccttaatttttctgctttaaagtaatcaactttttgtacaagtcagtcaaattatgtttttatgtatattgtgtatatgcatagacccagaaaatttcagacatatacctatttaggcttaaaattgggcatcacagtgtattttacaagaaaatatatttgaaaggcattttacaataattagtatttaattgtataggtcttgggatttgtaaaaataccagatccatcttttctttcagtagaatacattacttacctatggctagtaaatcaattaaataaattttatataaaaagttaacttattacatctggagctttcattctacgaaaggataaatatgacaacaaacatgtaatgaaaacaatagttagaggggtggatgaatgaatggaagaacatccaaatcatagaggttgtctttttattctgttactcattttcttaagttgtaaattttaaaacctcaacttcttttgaatctgttgagaaaacaatacacttggaatggtgagtcatcatcttagattcactaaaatctacctaagttttgaatggttctttttcagaatgcttgctgggactaagatttatctaaagtagcatgtttatgtttattttcatatcatctcggttgtggtttttggcagaaagaaaattgttttctaattacttaaaaaaatctgaggaaggaaggatggaagggagggagggaaagacatctaaagaagagtagctatgagttgatatttcagcctacccaaagaagcagagattgcgggacaaaaaataaaagataaaaaaaattggcttttcacgaaaatccatagagaaaatgaagtaggaaatcaaatgcataagtgcaaaacatagctcgatttaaagctaagtatatccttataaaataatgacttcttgaaagaacagcatgtttttcttggaaaacagggaaataattcccaaattattagaaaatcacctagattagacacatgaccacatgatcatttaattggtctcaatttttatttcaagagcagcaatgaagacatcaagaaagcagttaacatactaaatcttaagtaaactcaatgttgacgagaatgacaaccctaccatctgtgattataattactttctatatttgcgatttaaaaatgttttccttttaatttttggtagcctctgtaaattgtactgtcccactttttcttttgtaagaaatataattttctttcaattttatgaagcttttatgtctcaattttagtatagcaatttcttttttttttttttttttgagacagggtctgtgtctgttggccagactggagtgcagtagcaatcatagatcagggcagcctagaactcctgggctcaaatgatccacttcagcttaccaagtagttgaggtcactgtgccaggctaatttttttgtttgtttttagagagactgggtcttgctgtgttgcccaggctcttctcaaacagttggcctcaaatgaccctcctgccttggcctcccaaagtgctgggattacaggcatgagcaatcaagcctggcccttcatacagagatttaaaaatcagatttaatctggctcttctaacccatcctcacccaattggactgtaaagtttttgagtgtgtggatcacgtcttggttgttgttacttccccagtgtccagcatagagcccagaacaggttaaataataaatgtttgtttaataaataaatgattagaaaatgcatggtacatattttggcataggggcgtgtgtgtgtgtgtgtgtgtgtgtgtgtgtgtgtgtgtgtgtgtgtataaaatcacttccctgtatgccacagtatggagtctttggcaagatttttgcttctgttattcatttggatcaattaaattccctttccttgtttccctgtagaaactgcatgtagcactgactttagattactggcttaagtggttggggatcatgcattttgtcattaccaggtcagcaaaggagaacctgaaataattcacttctgtattcataaaagtatatatttgtatatatgtaatgtgtgtgtgtgtgtgtgtgtgtgtgtgtgtgtgtgtgtgtgtgtgtgtgtatagcttcaagttgtagaaaggaggagaaaaagtcactgtgggaggtggcagaggggaatttcctagagggaaacaatactgcaactgtaagaaaatgtaagaaatttgatagaagcacaaaatttcataaaatcagttataaaaattatgacatataagccccagttctgttgtcttgctataatgtaaaagtcacatttttttttaatcaaaatggaaaataaaaactagtagcagtgaatgtggtgagacagtagccactggcaccccaaggcaatggaaagcaagtgcccttgagcactacttttcacagccgggtgtcatgttttacctcacccagccgccttcttccctgcattttggtggcttgacaccattactgtcggggcagggtggggtggtaggggggtgcttgtgggagtgctggtgagggtccttcccttgctgcctgctctgtgctccctctttctggtgatgcagctgttctggtatactctctggcctctgtttttctaaatcctttaggtaggcttgctctccctattatcgctgggatcagaaaaaaagcagggtacgaagatccagaagacaggaaggaatacagtaagtgtgagtgaaggtaaaccagcctgctctcttcttgtggaacgatcacaaggtcatgcacttagatttatgaccaatcatcaagctattaatttactcaaatggtgtattaatttgttaggacggtcataagaaaatactacagatttggtggcttaaacagcagaaatttgttttctcacaattccaaaagctgtgaaatccaaggtcaaggtgtcagcaggtctggcttctccttaggactctggttgtcttgcagatggccaccttctcactgtgttatctcatggcctttcctctgtgcgcaggcatcgctgggatctctgtatgtgtcaaaatttcctgcttttataaggacatcagtcagactggattaaggcccaccctaaaggcttatttaaattttaatctcctctttagtggtcctatctccaaatatagtctcattctgagatactggtatttagggcttcagcatacaaattttggggtagacacaattcagcccataacaaattgtgctcatgaaatgatttactaataatgattgtggagagagatagtaatccgactgtgaatcctgaataattagtggcttcatgttcataaaagtggactcaataatgggcatgaacctgcacgagggaggcattgcggagaagaatacgtcccattttctgtaccaaagaaaaacaagtacacattgcaaacaataaatctttatcaaattcaaccaccttattttgaactctataatcattcaaacgtggcctagactaacatttgcttttttatagcttttatcaagaggagtggaggtattaaaattattattgaggggtgtagtgattttcaactgacgcaattctaccctccacctctcatgcaggggacatttggcaatgtctagggactttttttattgtaataagtgggaagtagctgatgatttcaagtaggtaaagaatagggatgttaaatctcctataatacacacgacagcctctcacaacaaaaaattatttgacccagaatgtcagtagtgctaaggtggaaaaaaccttatgtgaatcaattaaatcagggagaacttcagagcttttttaagacctttatttatatctagatgattgatattttttaggtattcatgaaaatactttcttttacctttcttgtggtaagcacaagataacactttcttgcctggttaaaaatggacaactgctacacttttaaaataatataaagcattcagtaattcaaaccatcctgtcttctgatttgtctgaattagtgtggctttactgcattttcagggcttattattctttcagtagggagactactaagatttcattaaagatagctgaataaatgatcaaatacattattgtagctccagactaggtaataaacattgagatatgcttttcaagtagtggtgaaaatactaggcaaaattacacatacacttacatatattaagcgaccatcctgttggcctggtatgtgaagctctgctgaactcttgcctaaatgcatggacccatcgattgtgaatgtgtgactacttgtgtgttttcatcataaccagctcatcctaatagcaaatgatatggtttggctgtgtccccacccacatctcatctttaattatagttcccttaatctccacatgctgtgggagggaccctagtagcaggtaattgaatcatgggggcagtttccccatgctgctctcgtgatagtgagtgagtactctgaaatctgatggttttataagcatctggcatttcccctgttggcactctttctccttcctgctgccctgtgaagaagatgcctttcttcccctttgctttccaccatgattgtaagtttccagagaccttcccagccatgtggaactgtgagtcagttaaccatcctttctatataaattacccagtattggatatttttcatagcagcatgagaacagacgaatacagcaaagaacacgttttatgaaggaaaaactttgaaaacaaagggactactttctttgatgagaggcccttcctttcactttaaacaaaacttcaaattatcctcagaatttgttctaattctccctacttctgggtaaaaattattagcagtaacagatttaacttgaatgtatatctccagttccccattctcttctctatgtagtgctgccaaactcaatagatttgaaacaaaaattacccagggaccttccccatctcccatgtccttttttcttatggcccagacctggaagtcctcctaagtgcttcctctccctcagcctaaccactctaccactatccagttgcaggtacactcttcctccttcacctcaccctttgatgccatctccactgctaccatcttgggtccaaccctcatgttatcttgcctgaaaaccgctaactttataactagtctctgttctatcaacatcctcttcctgactgtcatccacagatccactttctaaaatgccatcatgacgcttccatgcttataccactagcttttcagtggctaccaaaaaaaaaaaaaaaggttacattcccagccatcatgatctattcccttccacatctctgcatccttgtaaattgcccttgtcacccatgtatactgtgtattttaggtataaataactactagctatacctattttttgcctagagttccattctctcctcattttgtgatgaatcccatcattccacagatctttcctagaagacctttcataattttctatttccaaatggaagtgcctccttaactagctgtttttcttttcttctgtgtctgttactgcactatcataataaatcttaatttatatattttctatctttcctcctccctaagagtggcatgatggaaagagttgtttcagaaaaaatttggcaatggaatgctgcattaattggaatggaaaagaatgaatccctacaccaacagaaggaagcagtgtgaaatcctgacagggacaatttcattacaattacaaaatacataaatatgtgattacaattgtgagaactgctcaaaaggaaacaaggacccagtgagagtataaaaataagtacctaacatagtctgagtgtttggagaatgcttccctggggatgatgaggcctgaggatgagtaacaacatactctgctgagaaccacatgaatgaagccctgatgtgttaaactaaaaggataaggtgtctgaagtgtaatgaggcagagaggagagtggcaaaaataaactggagaagatgagtaggggagactactgttttcttacatgctaattaacccaataattctttatttcattttggagagaaacaagtgattatttattaatttattcattggcaatgcaatttaaaaacatattctttgtgtcttatttatcattgaggtttttaaaacattgaaataaacaataggtaatattttccaactgagatttaaaaaagaaaaaggtcagttttcaaatctattcccaactgctagagtttaataaaaactgtcataaatgttgacctttgttctgcaatcagttcagcatttatccatcacccaaccatgcagcctctcgcttgccaaaaggagtggaatgagaattgttagagtacttggaatgtttactgtcagcaaagtacaagacactacacaatcttgatgacctttatatgatagtcccatttctatatccaataagagacattaaattacttaataattctttggaactttctttttagtttttcatggctttgctcttaagttgaagaaaattattacatggatgaactacaaacggaaagcttctgttatcaccttttatcgtactttgtaaactatgataaatgaagtggcgaatgctgacaaagcattccaggctcaggatggcacctttcaaaggcaaaagaaggtgaacaatctactaacagcctttgaaacaatagtcaggactttggacttggcccataatgttgtgtttcatattgccctaagaaggttgctctaggaaggaaaatagtttagtggtgatggagagaagggcccctaagggaagaaatttgatgagaaggatgttacaggtgtctaaggaaaaggtaatcagctcctcagacaagatggaatgtgcattgaatttgaaaagatggtcagtgcttcattcatgtggttctcagtagagcatgttgttactcatcctcaggcctcatcatccccagggaaatattctccaaacgctcagactatgttaggtgcctatttttgtactcttactgggttcttgtctccttttgagcagttgtcacaattgcaattacatatttatgtattttattggcctaagggcttcctcccacgttcaatcataggaccatggaaacaaggttgaagcctatgttttaaaccattatgtgtctggtgctttgtctgggtcctggtacataatagatattcaataaattcttgtaaaattcattttttttcaactgagagtacaaaagtaatcagacagtaaatatatgtgtacccttttggagaaacattaaattcattccattagcaggcaatgagttctttatttaaaaaaaagttctttcagcaacttccaaatgtacatctcaagctctgaccactcctcccctttagactcctactaactgcttggaaattatttcagttgttctcatggccaaaattgaactcatcatcttactcttaccatctggtctttttcttctatttctttgttggattgattactacagagttatctaaactagaaacacaggagtcaccttagtcatcttcctttatcttaacactgtctctcatcatcaagtcttcttttacctataatgttcttatatgagtcccttccactctgtctttattaatattgccaactgatgtgaactactgtaagagcctctgaagtgatctccacattgctggttttcatataatccaccccaaaggtctttgtgtttgttggttggttttcattgctatagcaatattcacatttctgcagtactagtaaattacactaaaacgtactgtgttttataattgacctcgagtataaacatacaaattctactgctctgatgtttctttctaagcaatggttgaatcaaaaaacaatgaatttgcctaattttcatgatgaaaacgttcaaaattctcctaagatttcttgaaatccaagcttgtgattgtatgagaattcacaataaaccagctcacaaaatgtataaacttcagtttgtcatagtctatgaggaattactgaagcatacggcatttactcattgatttttaattcaggcaaaagttagaaatacacaaacacatacgcgtacggaggtctcaaagtcagttgtgcgataataaattatttaactcacccttatgataggtaaacagttttcctaaatcgccctcctgccccctgctaccctgactgaaaatatgtgctctggtttgtgctgttatttttgaacaatgtatgccggtatccgatgtaagatgattcatatgatactggtgttaccatggcaatccatcatgtatatagcaagaacactgtgaataccagcagctctttgttctcttcaagtttccattttcttttcttgtttttttttttttttttcttgtgcagtaatccagtggctatgacatcaagagtaacacaatctaattttctccttctgttgcttgtggtaggattcatactctgctagcaagggagttcttggccattttgatttgcaagagattttgcttctccctgatgtttcatttcgtcagcaaagtcttccctctggggaaaaacccacttgaattctaaggctgatagatgctgggaatcccatatgatgagtcctgtggaagcaggacattccagccctggggttgctgttgtctctgacttcagtatatgttcaaagtcatctcaaaataaagtaggaagatgagtgttaacctgcacatcactggcagtttttaaaggtaaattgccatttttacttaccacactggattctccaagtcagactaggatttgggttacaatggggatcattggggttaaattacttaagggataatgagatttacacagacccattaatctttctaagctattgagaaattttacacgtactgtgactgaggagaacctgatactgtaaaagagcaattcagtacagtttcaccatccaaggacttaccgatgcaaattcaaatacacgtgctaagtaaaatgggagagatagagcaagggagatataaaaattccaatagagcaattccagatgccccatctgccaccacgtgcaatggatctatgttcactagtaagtgtgattgaggtaggagatgtggatctaccactcttcccatctcagttcctttggtgaactgttgagtgtgaacattttgccttacattgggtgattcaaggggttctccacggtaaaagtgactatgtcagattcttgccacataatctaagagatgactccactgaagtttgtgttactctaccatcaaaagatgtatctatgtttacagacattcttttattcaatttgaaaagaaatttcaatgtcaataataaatattagcctcatttgtgaattaaacagatgttaagattgcatgcacgtcagtaaaaaaactgttgtacaggaaactctatgcacaggagcctcctaccatgtcatccagctcagctacctttttctattcagctttctgcaagtatttattttatataatgcacatgtaactataaggatacaaacatggatcatacaaagaacctgccctcatggagcttaaaatctaaagacagatgataagtgctaaacataaataactgtccacaacattaagatatcagtaaattcattcattcatttaattcactcatacattcacttgtgcagcaaacatttactgaataggaactgatttcaaaattttcagctaggaatgcaaaactgagagagaaaaattcttagccttcaaaaaaatcaaagtcgaactgctcagacaaaaattcaaagggaaaaataaattataactacataaggactttaatagtcctctaggagtacattagaccaaacacctaccaccagctgggctattcagggattatcttacaaataaggtcatgaaagaggatgaagtactctcctgaaaggcagtgcctaaaaagagggtggctggcagagaatgaactcacattacatagcactttgcagtttgcaaagtagatagtcatatattgtttcctttgactatcacatcaactgataagaaaactgagacccagcagattcaaaggtcttactgaagaccataaagttagttaaatgtggccaggtgcagtgagtgactcacacccataatcctagcagtctgggaggccaaggtgggcagatcatttgaggccaggagtttgagaccagcctggccaacgtggtaaaacctctactaaaaatccaaaaataaaaattagccaagtgtggtggcatgcacctgtaatcccagctactcttgtgtctgaggcacgagaattggttgaacctgggaggcgaaggctgcagtgagctgagatcgtgccactgcactccaccctgggagacagagtaagactctgtctcaaaaaaacaaaaaaaaaattgttaggtaaatcctggagttgggacccaggcaccagtcatctgttctctaaatattgtcccatgtgttctgttaagtaccatggagaaagcaggagtaaaatattttggcagctctgagaagggagaatttactttcaactgggagtatcagagaatgctttgtagataaaatgacatttggtcttgcagcttgcattcagttatgcagagttgaagatgaagggcatttcaggctgggagaacaatctcacaaaggtgtggatgtaggaaaatacatgaacgtttatagaaaaaaaattgagtgtggtcagaatttattgaacttgagaggcaatcatgtagataggagataaaacaggaaaaggagaatgagactatatttttagggtcatgaaaattaagcaaaggaatattttctaaactaaggtgagctattaaagattttgaagagagggagtcctatgatcatagctttgcttatgaaagaatgaagtggcagcaatgaagacacaccttggaataccagaagactagagtaaggagactaatgaggggacttatagcaatcatttgctttgcaggtaataaggtggtaactaatacaagatgatggattacaatattaaattttgtattcttttaagttctatgtttctgcaatggctaaatgcaaacctatcaggaaaagtaaagcgttttgttgttattgttgttgtttttgcttttcaaaaagtgcaggtaattagggcctaacgtggaatggtccatgctaggaataaagtagatagcggcgaatgtttgctagagacattgtgatggactgatctgccctactattacatcctcagcaataaatatgaatgtttaagtggtacaattgccagaaatcagccaaagtttggcataattgttagagatttgttggctgtggatagaactacataattttggaattgtagaggagaacagagaagaaaccaacaaaaaatagtactagtactctgtcactggaaagaagtatgtttaaggccacacagtgaaagttagccatgagcttgagtgctctatcatttttcattatgttgtttgtttattaaaaaaaaaaaaggtaacagctttttctttttaaccaaacatttcttactggaagttcaataggtgtacagttgttttgtttggctagacatggatatttgtgtgttattccctttcagtagttctgaaaaccattttatctttagatacattattttcccaggagcttgggtattttattgaagctgtttcaaatgcatttaatgtcctttgtaatggatttctttatctcttccccaatgctcttggctggagatgttactttttatttgccttatcggtgtgagcacctcattgctataatcaatagatatagtactttagcattctgtacattttaatatgatatataccaaatataatgtataaatgaaaagttatagataatttttgcttaagttttcttttatagagaattgttaacaaaggatatacagccaatatgttaaaataatacctagaaattaaaaaggagtaaagtagaatagtttatctgttgtactaagacttcatacacaatatttcgaaaagtgggaatatctcttgggtgaaatacttcatatatgtattgtatgtacatacatgcaatatgtacacacagaattatataaaatatatgtatatgtatacatctatatgtacagaacatataattttattagcatttcttgtaatggcattttattataaatccaatgacctcaattattctatgggtaagtgctaagtatgtcaagagagctggcatagaaaatggaaaaagcactacaccccttagcttgcaagtagatgtgaattttctgcctttgactttgttgaatctgtgatgaatcatatgtttactctgattaacataaaacatctggatgatctaactttggggacacattgcttcatatgcactgaatgcctgaaaattggtagaattttagattctttttctttataaatgatactacccgaattcctgcaatacctagagagttacaagtgcttagctctgaccttttattccattcaattgaagttgtccacctttagtttattacacatatgactcttagtagagcaaacatctggattattgtcaacagttctcaaacacaccatttggatttcactatcagactacgaacgaacccccatggaaaaaaattcaggcatacaggctacacccagatcctgaatagcccctggttttctggttactattttctcaggccagatccaagaagtcctctttgggcttgtctctgggattctctgataaaattggctttagattgagactgacgtgaagatagagctggtcattgaaagacagaaacagatgtgaatgaaataattctcctttgagacataaaaaaatgtaagatataccaagaaaggggaatttgagttgttcattttctgacaactgtgaaattgttgacccggacaagagagtagggagattaacaatgtgatcatgttcagggcccactgtgccactgaattaagacaatgttggcattctcctcagtcatcttccgaaaatagagatttagagttaggaaaggaatagcctatcccattaactacgtcactcatctcatgcaggtgacctctcatttatgtatttctcaggatatagaccaacgctggagtatagaaatattatgagacacttcgtaattttaggtcttctggtaccacatttaaaaggtaaaaagaaataggtaaaatttatttcaaggatatattttatttaactcactgtatcagattattttaacttgtaaacaatatatataattattaatgagatatttaacattctttcctcatactttgtctttgaaatcctgtatgtattttttacttacatcacatattaatttggatgcccaattgtcctcaattatactggatctttattggacatttagatctcataagatttacaattagaaatatagattcacttcccaagttgttccaaatatagtattattaaatcaactatcagtcttttaattcataaatattaagtaagactaaaaatttagtcctttagtcatactaaccccctttcaagtgcccaacagcctcttgtggccattggctgccgtattagacagttcatatttagattatctgggtttgaactcagagtctgccactcactgactgtattggcaagttgttgccaacctgggcaagttttttctctttttatgcttcagtttcctcacctgagcacacctttttccttgaagaagctctcctgaagaaaatcccgtatttttcttcaggacattgctatttttccacttaaactcagaaccttagagtgatcactgaatcctcctctccctcatcagctttatctgccagaaggtcaagtcctctgagatgtacactgtaaaatctcatgctttcctgtgacttcatttccactgccactaccctctccttttgcatggatagctgcaatgatctcctatttaattagcctcagtctccagactctagccatcactccacattatgccctctggatgctgctactgagttcattttctgaaaatggtatctttatcatactctccacagttcaaactatttcttcactgcccgtcacttccagcataaatccatgtcctctgtgaaaccttttttgacaacttccatgccagatccaaatgacaactcccttccttgtgctgtcatggccctccacacagacttctgccatagccccagagtcctagtccacatataggagtacatgggctctaagccctacacagactattttgttgttgttatttttgttttgttttgttgtttgttcgatatcttgatatctctgtaacagagcacagtggtttcttgacagtttctcattttctgtatgagctagtgaatgacattcctttgtctggcattccaggccttcagaattagctccacttgactcttctggctccttctcttgcttttcatccacacagatcctctggtatagacaaactggtgtattactgtctcacaaatatgtccccaatgtttgtgtctccatgccttggctcgcatcctctcctcttctgaagtgtccctgcattcttcttgatctgcccaaattctaccctttcttcaaggtccagtccctccctcttccatgatgaagactgcggagcatgatgcaattcactgtgtttcaaattcaggattgggtggcctgatggaaggaggccaggcttggggtccaagtggatctgtttcttctgttttccgccaagttgcctaccctctctgaggttcacattccatatctttgaaatcacagtaacaaaacataaggtgcagaactatcttgagtattaagaataacgtgtgcactggcattcagtgagggttcagatggagcacgtgaactctgttactttcagtacagtcataggatatgtaatcatgtagcttctaaaatgtctttcattgtaagattttgttgtcatttggattgctatacaattcatgcttgatttctaaactagactgcaagtgtctggactgaaacaaatgcataatagaattctgagcagatatgcacagatatatatatgtgtgtgtgtatgtgtatatttgtgtgtgtgcacatgtatttgtagatatcaagggagagaggcactttcatgtgtattgattcattcagtccccacaagaaagcatcattctaggaggaagttgaaaatgtccctattttatctatgaagactctagacttgaagagtttgagtccttcccaaatcagtccaactcttaaagtgatagaagcaaaaaattcacagtgtttacacatcttttccaaagctgtttgatgttattatttcccgcatatcacatctgtgagattatctgcctagatcaatatatgtgctaaccatctgtcaatctttatctacatgcaattgtacccaggttcagggattgtgggagggagaaaggttaggtggttgtaagaaggacactgcatagtatggtaggcaaatacagaatacctgcaacaagacaaccatggcatttcttttttttttttttttttttttttgagatggagtctcactcagtcacccaggctggagtgtagtggcgcgatctcggctcactgcaagctctgcctcccgggttcacgccattctcctgcctcagcttcctgagtagctgggactacaggcccccaccactacgcccggctaatttttttgtatttttagtagagacggggtttcaccgtgttagccaggatggtctcgatctcctgacctcgtgatccgcccaccttggcctcccaaagtgctgggattacaggcgtgagccaccgcgcccagccaaccatggcattttttgttaggtcactcagcattggtatcaagaataacaaatgacacttgagtttctttttcctgaaaaagggcaggaagagtctaatagcaagtgcaattgccacaggcaacagtgttataactggaaaatcctaaaatgtagataattttcctccaaatgctttctaacaaaagatagacaagtttaaatttggctgatttcatatctaccataatatagtaccagcaatgccaagatacagaaaactgcctaagaaaaacagagttcagaagacttcggataaattatcatcttaagcttaaccttatacctataaaaaattcagggatatcagttatgacttctcattgagtagtctcatgttagaccaaaatagtttcccatattttggtgaaggaccagaataacttaccagtaaatgaaacaatcattttctttttgctttatactcattctgcatgtgatttgtataggggatcaagtcaaagattgccagtacaaagtaacaacctctcattgtattgcttaagttaatcattaatattttccatggatcaataccctgtagaagcatgagatgcagcagtgatcttcaatttcatgtgcttgccaagtaagaacagccatgggccagattgttgggagccgtgccatgagctacagaccctcagctcccctctataatcagttcttcccccactccagtgctcccaacttgccctaagcagagcgtaattgtggatgtgtaactaccgcagaggggagtatgctttttatgttgttcaattcttcactttctcttctgcaattgaaagttgagctgttagatttcctgaaatgaaatggtgacaagagaaagtaacagaagtagcctttataagtgcctgacttctgggtaacagaagtgacttaaaaaaaataaaagtacaaaacgttgcatttaatgtaaaagatgactgcattagtacaacccttgaaaacattcaagttcttttcagaataaccaccattaaggagttgacaaatattttatgctttaaagtatcctataaaagttcatcacagaaataaaaagcctcctgttcttatccttctcaacaaagccctcttgtatatagatattgagtctggcttacctctgtatcctgttgtgctgataaaccaagaaccttgcaaaaatagatgcacgataattgatatttaataagtgagcgaatccattaatgaaaagagtgctatttcagagagcagtgttcatttagatagatggtcccagcgtcattaagtaaaaggatagagaatacttgcaatacatttggcgtagtgttaagaattttttaaaatgttttaaatgtgatcttttttatgggctgaattgtgtcctctcaaaatgttgaagtcctaacccctggtacctcagaatgtaaccatggagataaggtctttaaagaggtgattaaattaaaatgaggtctttagagtggcccctaatccaatctgaatgatacctttataaagggagggaatttggactcacaaagagacattagacacatgcacacagagacaaccatgtaaacacatggtaagaaggcagccatctgaaagccaaggagacaggtctcagagaaactaaacctgttgacgcctttgatcttggacttccaaactgtagaacactgacaaaacgtattactgtcgtgtaagccacccaatctgtggtattttgttatggaagccctggaaaattaatacagtcttttttatttgctacctttgaaagccctcttgtcaaatgacggtaaagaatagaagacaataaagtgtcagtaataaagggtgacgagaagaaacaactagagatgtgagaggaccaatttaggaaatggaaaggagaggaaaaaatcaacaaagttgagaatgctaattacaaagtgcccacagaggagggcaaaaccagcaaaccattccctttgtcaaaatcttgaaagatggcaattgaggaaccaagaatcttaaaaaggggggaaggtggatgagaaatctgcatatgaaggggagtcctccataggttctcctctcaccctgctcagctaggagaccagtgccactttatcctcattagaatggaaatttatgctataaaaataaataagagaagtcttaacctggggatactaggcacattggaaggtgagagagtaaatgaaagtctatcaactgaatagtgaagttctgacttctctagtagcacctgggaataagaactctgtcagttagccttataatgccaagagaggagatagaaaaattgtttttctataaaaattgtctaaaaaaatatctgcactcccatgtttattgtagcactattcacaatagctaagatttggaagcaacctaagtgtcccatcgacagacaaatggatgcaaaaaaacatgcagtacctataaacaatggagtactattcagccataaaaaaagaatgagattgtgtaatttgcaacagcatagttggaactggaagacattatgttaaataagccaggtacagaaagataaactgcatatgtcctcactaatttttggtaactaaaataaaaatacttgaacttgccaggttcaggggctcacgcctgcaatcctagcactttgggaggctgaggcaggcagattgcttgaggccaggagttcaagaccagtatggccaacataatgaaaccccatctctactaaaaatataaaaattagccagtcatggtggtgcatgcctgtaatctcagctacatgggaagctgaggcacaagaatcacttgaacctgggaggcagaggttgtgatgagatcgtgccactgcactccagcctgggtgatggagtgagactgtctcaagaaaaaaacaaaacaaacaaacaaacaaaacacttgaactcgtggagatagagagtaggatgccatttatcaaagagtgggaagggtagtggggaggaagaataagatctagtatttgatagcataagagggtgactacagtcaacaataatttattgcatatttaaaagcaactaaaagaatataattggaatgtttgtaacacaaagaaatgataaatgcttgagatgatggctcctccatttatcctgatgtgattattacacactgtatgcctgtattaaaatatttcatgtgacccataaattcatatacttactatgtactcataagaattaaaattaaaaataaaaataaccaagaagaattcttcttcagaaaaatggaattaccacccagagaaaagacctatagtactggcattagatggttgcccaataaagaagccaagggtctttattcctcaattaccccatgtattaggccattattgcgttgctataaagaaatacctgagagactgggtactttataaggaaaacatgtttaattggttcacagttctgcaggatgtacaagcatggtgctggcatctgctcagcttctggggaggcctcagggaacttgtagttgtttcagaagacaaaaggggagtaggtgtctcaaatggtgagagcaggagtaagggggttgtgggagttagcacacacttttaaacaactagatctcagagagctcattcactcactcaccaagccataagggatctgcccacatgacccagacaccacgcaccagggcccatctccaacactggggattacatcccaatatgagatttggaggggacacccaaactgtatcattccgcccttggccccctaaatctcatgtccttcttacatggcaaaatggaatcatctcttctcaacagtctcccagagtcataactcattccagcattaactcaaaagtcccaagtccaaatacaaaatcttgtctggaaatgagttcctcccacttatgagcctgtaaaattaaaacaagttatttacttccaagccaaggtacaatagaggtacaggcattgggtaaacattcccattctttttttttttttttgaaatggagtctcgcttagtcacccaggctggagtgcaatggtgcaatcttggctcactgcaacctctgcctcctgggttcaagcgattctcctgtctcagcctcctgagtagctgggattacaggcacccgctgtcatgcccagctaatttttgtatttttgtagagatggggattttcatcacattggccaggcttgtcttgaactcctgacctcaggtgattcacctgtctcagccgcccaaagtgctgggattacaggcatgagccatcatgcctggccaacatttccattctaaaaggaagaaatcagccaaaagaaatgacttcaggccccacccaagtctgaaacacaacaggacagtcattaaatcttaaagttctaaaataatctcctttgactccatgtcccacatccaggtcacactgatgtaagggtagactccaaggccttgggcagctctgcctctacagcttttgcaaggtgaagcctccatgactgctctcatgggttggagttgagtgcctacggctttcccaggtataggatgcaagctgccagtggatctacattctgggacccacagaacaatggcttccttcccacagttccactaggcaatgccccaggggggattctttgtgggcagggcttcaatcccatattcccttctgcactaccttagtagaggttttctgtgaggactctgtccctgtagcatgcttctgcctggacacccaggctttctgatacatcctctgaaatctaggcagagactaggatcactctttccattctttctatctgaaggcttaataccacaaggaagccacaaaggcttacagcttacatgctccagagtggcaacctgagccatacctgaggctctttgagccacggctggactggatggaccatgatgcaaggagcagcctcctgaggtagacagtgtagtggtgccctgtgcttatcccctaaaccatttagtcctcctgtaccactgggactgtggtgggaggagctgcctagaagatctctgaaatgctgtaaaggcctttttcccattattttggctattagcacttgttctcttttagttatgcaaatttccctagcaaatgattgcttgcagcctgcttgaattcctccccaaaaatggccttttattttctatcacatagctaggttgcaaattttccacacttgtaagctctgcttcccttttaagtaaaaattccaagtttaggttatttctttgcttctgcatctgagcataggttattagaagcagccaggtcacatctcaattgcttcagtgcttagaaatgtcttctgccagataccctaagtcattaactcttaagttcaaactttcacaggtccctgggcatgaatataatgtagccaagttctttgctaaggtataacatgggtgacctttgctccagttctcaataagttcctcacttacacctaatactttgtcagcacggactttactttgcagatcactatcagcattttggtcatgaccatttaatcagtctctaccaagtttcaaacttttcctcatctccctgccttctcctgagccctcccaattcttccaacctctgtctcttacccagttccaatgtcattttgacattttcaggtatctttatagcaatgccccactccttggtaccagtcttctatattaggctgttgtggcattgcaataaagaaatatctgagactgggtaatttatgaagaaatagaaaattaactggcttgcagttctgcaggctgtacaagcataatgccagcatttgctaagcttctggagaggcctcagggagctttcaatcatggtggaagctgaagagagagcagctatctcacgtggcaatagggggagcaagagagagagcgggaaggaaggtgttacacacctttaaacaaagagattttatgagaacttgctcacaaagctataagggaaccactcccatgactcagacacctcccaccaggccccacctccaacactgaggattacatctcaacatgagaattggaggggacattcaaggaacaccaccctataatgaaccccaagactctacaagtccagttaaatcattcaaggctcccagtcagtattttagtgtctccctgttgaatatgaatagatagccaagtctccacaaaactctgaggaaattcttcaacaaaaagcctaatgcaaacaaatgaaaataatgatgatgattaggttgatataaaaagagtttaagaaacaaatagacgtttcagaaaaaataaacttcgtagccctagacagatgacaagttatcacattaatgaaacaaaaggatactatacaaaattatcaagtaagaacaaaagagagttagaatttaaaacaatgaaagaagatgctaataaataaaatcagagatgaaaagggagatgttgctgggcacaatggctcacacctgtaatcccagcactttgggaggccaaggcaggcagatcatgaggtcaggagtttgagaccagcctgaccaatacggtgaaatcccatctctactaaaaatacaagaattagccagcgtggtggcacgtgcctgtaatcccagctactcagaaggctgaggcaggagaattgcttgaacctgggaggcggaggttgcagtgagccaagattgtgccactgcactccagcctggatgacagagcaagactctatggggggggggggggggaaggaaagataaggaaagataagggagacgttacaagcaataccacagaaattcaaaggatcattagatgctactaggagcaactatatgcaaataaattggaaaacctaaaaaaatgataaattcctagacaaatacaacctaccaagatttaaccatgacgaaatccaaaacctgaacagaccaataccatcaagattgaagccataatgaaaagtctcccagtaaagaaaagcccaggatctgatggctttactgcttaattttgccaaacatttaaagaagtaatatcaatcctactcaaactattctgaaaaatagaggaggagggagtacttccacacttattgcacaaggccagtattaccctcataccgaaacagaccaaaggcacattgcaaacagaaaactacaggccaatactcccaatgaacatttatgcagaaatcctcaacaaaatactagcaagccaaattcagcaacacattaaaaagattagtcatcgtgaccaagtgggatttttcccaaggaagcaaggatggttcaacataatgtaaatcagtcagtgtgatacatcatatcaatgaaggacaaaaacatatgatcatttcaatttatgctgggaaagcatttgataaaattcaacatcccttcatgataaaaactcaaaaaactgaggatagaaggaacatacctgaacacaaggaaagccatatatgacagacccacagctagtatcatatcgaatggggaaaaattgaaagtttttcctccaagatctgtaacatgacagggatgtccattaccccttgagcaatcagacaggagaatgaaaggatattcaaattggaaaggaagaagtcaagttattcttgtttgcagatgatattattttatatttggaaaaacctaaagacttcaccaaaacactactagaactggtaaacagattcaataaagttgcaagacacaaattcaacatataaaaatcagtagcatttctatatgccaatggtgaacaatctgaaaaagaaatcaagaatgtaatcccatttataatagctacaaataaaatacctaggaattaacttactgaaagaagtgaaagagttctacaatgaaaactataaaacacggatgaaagaaattaaagagaacacaaaaaatggaaagatatttcatgttcatggattggaagaatcaatattgttaaaatgtacatagtacccaaagcaatcttcagattcaatgcaatctctatcaaaataccaatgacattcttcacagatatagaaaaatatcttaaaattcatgtataaccacaaaagacccagaatactcaaagctatactgagcaaaaagaacaaaactggaggaatcatattacctgacttcaaataacactacagagctatagtaaccaaaacaggatggttctggcatgaaaacccaggaacaaattcatacatgtacagtgaactcatttttgacaaaggtgccaagaacatacattgagaaaggacagtctcttcaataaatggttctgggaaaactggatatctatatgcagaagaatgaaactagacttctatctcttgccgtatacaaaaatcaaatcaaaatggaataaagacttaaatctaagacttcaaactataaaactattgaaagaaaacattggggaaactctccaggacattggcctgagcaaagatttttttttttttttttagacagagtctcactctgttgcccagactggaggctgaagtgcagtggtgtgatctcagctcacagcagcctctgcctcctgggttcaagtgattcttgtgcctcagcctcctgagtagctgggactataggtgcacaccaccatgctgggctaatttttgtatttttagttgagacagggttttgccatgttggccaggttggtctccaactcctgacctcaagtgatatacctgcctaggcctcccaaagtgcatggattgcaggtgtgagccactgcgcctggcctgagcaaagattttttgagtaataccccacaagcacaagcaaccaaagcgaaaatagacaaatgggatcacatcaagttaaaaatacctgcgtagcaaaggaaacagtcaacaaggtgaggagacaacccacagaatgggagaaaatattagcaaactatccatctgacaagggattaatatccagaatatattaggagctcaactccgtaggaaaaaaaatctgataatccaattaaaaatgggcaaaacacctgaatagacatttctgaaaagaagacatacaaatggcaaacagtcatatgaaaaggtgtgcaatgtcattggtcatcagggaaatgcaaatcaaaactgcagttaaatattatctcaccccagttaaaatggcttttatccaaaagacaggcagtaacaaatgctgacaaggatgtagagaaaagagaacactcctacacttttggtgggaatgtaaattagtacaaccactacggagaacaatttggaggttcctcgaaaaagctaaaaatagaactcccatatgatccagcaatcccacttctaggtaggtatacacccaaaagaaaggaaatcaatatatctgcacttccatatttattgtagcactattcacagtagccaagatttggaagcaacctaagtttccctcaatagacgaatgaataaagaaaatgtggtacatatacacaatggagtactgttcggccatagaaagaaatgagatcctgtcatttgcaacaacatggatgtaactggaggatgttatgttaaatgaaattatccaggcacagaaagatcatcttcacgtattctcactatttaagggagctggaaattaaaagaattgagatcctggagatagagattagagtgatggttaccagaggctaggaggtgtagtggatgggaggaagtaagaagtggggatgtttaatgggtacaaaaatataattagatagaacaaataagatctggtatttgatagctcaacagggtgactacagtcaacagtagtttatcatacatctcaaaataactaagagaatataattgaattgtttgtaacttaaagggtaaatgtttgcagtaatagattccctgtttaccctgatattattatgcattgcttgcctgtatgaaaatatctcgtgggccccataaatcaatcaatctatctatctatctgtctgtctgtctgtctgtctgtctgtctgtctacctacctacctattatgtaccaacagaaatttaaaatttaaaaaattatgttttggagacgtctagaaaaattggtgataatgtcacataatcaaataaagaaggtaatatataactccagaaaaaacaaaaagttgttccataaataaaacataattatggcacatcatttggtttatcagtaaacgttactttgcagggatgatacaatagaacactgaatgtttatttagccaataattgttatataactgtaatgggaggatagaaagagggaagtagagaggtgaaatggtgaaagagtgtgaaatcttcatcattcataatagaaagtcagttagaaatatggaatttaaaaaaaaatagtttgagagccttatgaagagggtggcacaaaagactcctgcaacttgttctaagccctgtgcatacaatttggggtgtgtgggttagtttaataattattttgtaaatataaaaggaaccaaagcaaccaaatttctggatataaatgtcctgtgttgattatcatgataataggtagacatcttggattggaattttttaacatttgaatggaataccccatttcccctttaatctttgataggtttaacatggtcactaactgtagagtagggacttgtcgtgctctttattggcagaagtgtgactggctacccctgaccgttcgggagaggagacatgtacacctggccaatcagaccagcagattcactgctggtgatgagtgaagttgcagatgtcagggacagcttgtgctgttcaggttaaattatctcacttcagctctcactctaaagatgatttataactagtattcttcactttcagtcttttcactagcaagcaggatacttatggaaaataattaggatgaaaagaggtcactctatcacaatagtgagtttttgaattcacactttaaacgagatgatcctccttaggaaaagcaaaataaaacgaatttccatgccattgttgattctacttgagttaaatactaacataaaaagttggttttctgtgcatagcctggagaatcttgtctctcagaattatcatgccccaggccattccttgcagattttgaattccctttgtctcaaaaacatccagaaaatctttttgaccttcgggtggttggcagaacatgtgttgtgagggcacctcagtttagaagaaaagccctgaacttagttcaaaagaagggctttccagcatgctattcattcagcttaggactgccaggcttcctgaaagacaggtgtgtcagaaacaaagtaaataaacagaaactcacaatgtccagacctttctctccagagcagcacagttcccttgctgagcggcaacagccaaggctttaagctgttccctctcccttttctgttaattgagaaaaccaattgctgcaagagcaacatcagcagagctaaatgtaaatggagtttaatagaaagagacaaataacccactgagaacccctaacatttcagtgtaataccccagagttccacaccataaacttggtattccagtataaagctcatctctcaattgcacgccaccctcccccatcttattcactctcttgcattattaaaggagtgatctcccccatgggatcaaaatagatagatagatagatagatagatagatagatagatagatagtctctaatatatgtattagaaacagagtctgtgttgcccaggctggagtgcagtggcatgaccataggtcactgtaaccttgaacgtttgggctccagcgatctacaggtgtgcaggtctacaggtgtgcaccaccatgtccagctaatttttaaaatttttgtagagacaggatatctctatgttgcccaggctggtcttgaactcctcttctcaaatgattctcctgccttggccacccaaagggctgagaatacaggtgtgagctaccatgcccagccataaacatgaaatttacttatgttttatgtataccatgtgcacatagcctgaaggtaattttacacaatattttaaataattttgtgcatgaaacaaagtttgtgtacactgaaccatcagcaaaggagtcactatctcatgtcagtgaccaaaaagttttagactttggagcattttggatttcagagcatcttgaattttaggtttttggatggggatgctcaacctgtatatatgcatacatgcatatttatgtaacatacataatggtacctaaaacttagcaaatactcatatgttagctattatttttgttggtattactatgaataataactattagcattttctctcatatctaaaatgcagttggtaaatgctaaactcataggaatgttgtaaagatttatttttttattttttttattattatactttaagttttagggtacatgtgcacattgtgcaggttagttacatacgtatacatgtgccatgctggtgtgctgcacccactaactcgtcatctagcattaagtatatctcccaatgctatccctcccccctccccccaccccacagcagtccccagagtgtgatgttccccttcctgtgtccatgtgatctcattgttcaattcccacctatgagtgagaatatgcggtgtttggttttttgttcttgcaatagtttactgagaatgatgatttccaatttcatccatgtccctacaaaggacatgaactcatcattttttatggccgcatagtattccatggtgcatatgtgccacattttcttaatccagtctatcgttgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgattgccattctacctggtgtgagatggtatctcattgtggttttgatttgcgtttctctgatggccagtgatggtgagcattttttcatgtgttttttggctgcataaatgtcttcttttgagaagtgtctgttcatgtccttcgcccactttttgatggggttatttgtttttttcttgtaaatttgtttgagttcattgtagattctggatattagccatttgtcagatgagtaggttgcgaaaattttctcccattttctaggttgcctgttcactctgatggtagtttcttttgctgtgcagaagctctttagtttaattagatcccatttatcaattttggcttttgttgccattgcttttggtgttttagacgtgaagtccttgcccatgcctgtgtcctgaatggtaatgcctaggttttcttctagggtttttatggttttaggtctaacatgtaagtctttaatccatcttgaattaatttttgtataaggtgtaaggaagggatccagtttcagctttctaaatatggctagccagttttcccagaaccgtttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggtttgacttggtgatgcaggctcttttttggttccatatgaactttaaagtagttttttccaattctgtgaagaaagtcatgggtagcttgatggggatggcattgaatctttaaattaccttgggcaatatggccattttcacgatattgattcttcctacccatgagcatggaatgttcttccatttgtttgtatcctcttttatttcattgagcagtggtttgcagttctccttgaagaagtccttcatgtcgcttgtaagttggattcctaggtgttttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtagtctgcaaacagggacaatttgacttcctcttttcctaattgaataccctttatttccttctcctgcctaattgccctggccagaacttccaacactatgttaaataggagtggtgagagagagcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgtagggttgttgaattttgtcaaaggccttttctgcatctattgagataatcatgtggtttttgtctttggctctgtttatatgctggattacatttactgatttgtgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccggctttggtattagaatgatgctggcctcataaaatgagttagggaggattccctctttttctattgattggaatagtttcagaaggaatggtaccagttcctccttgtacctctggtagaatttggctgtgaatccatctggtcctggactctttttgttggtaagctattgattattgccacaatttcagatcctgttattggtctattcagagattcaacttcttcctggtttagtcttgggagggtgtatgtgtcaaggaatttatccatttcttctagattttctagtttatttgcatagaggtgtttgtagtattctctgatggtagtttgtatttctgtgggatcgttggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttaccttctgctagcttttgaatgtgtttgctcttgcttttctagttcttttacttgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcattatgtacccagtagtcattcaggagcaggttgttcggtttccatgtagttgagcggttttgagtgagattcttaatcctgagttctaatttgattgcactgtggtctgagagatagtttgttataatttctgttcttttacatttgctgaggaaagctttacttccaagtaaatggtcaattttggaataggtgtggtgtggtgctgaaaaaaatgtatattctgttgatttggagtggagagttctgtagatgtctattaggtctgcttggtgcagagctgagttcaattcctgggtatccttgttgactttctgtctcgttgatctgtctaatgttgacagtggggtgttaaagtctcccattattaatgtgtggaagtctaagtctctttgtaggtcactcaggacttgctttatgaatctgggtgctcctgcaggtgcatatatatttaggatagttagctcttcttgttgaattgatccctttaccattatgtaatggccttctttgtctcttttgatctttgttggtttaaagtctgttttatcagagaccaggattgcaacccctgcctttttttgttttccatttgcttggtagatcttcctccatccttttattttgagcctatgtgtgtctctgcatgtgagatgggtttcctgaatacagcacactgatgggtgttgactctttatccaatttgccagtctgtgtcttttaattggagcatttagtccatttacatttaaagttaatagtgttatgtgtgaatttgatcctgtcattttgatgttagctggttattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaaggattttatttctccttcacttatgaagcttagtttggctggatatgaaattctgggttgagaattcttttctttaagaatgttgaatattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctgtgtatttcctgaatctgaacgttggcctgccttgctagattggggaaattctcctggataatatcctgcagagtgttttccaacttggttccattctccccatcactttcaggtacaccagtcagacgtagacttggtctattcacatagtcccatatttcttggaggctttgctcgtttctttttattcttttttctctaaactttccttctcacttcatttcattcatttcatcttccattgctgataccctttcttccagttgatcgcatcagctcctgaggcttctgcattcttcaggtagttcttgagccttggttttcagctccatcagctcctttaagcacttctctgtattggttattctagttatacattcttctaaattttttttaaagttttcaacttctttgcctttggtttgaatgtcctcccgtagctcagagtaatttgatcgtctgaagccttcttctctcagctcgtcaaagtcattctccatccagctttgttctgttgctggtgaggagctgcgttcctttagaggaggagaggcgctctgatttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgcagtgtgaggtgtcagcctgcccctgctggagcctcccagttaggctgctcgggggtcaggggtcagagacccacttgaggaggcagtctgccagttctcagatctccagctgcgtgctgggagaaccactgctctcttgaaagctgtcagacagggacatttaagtctgcagaggttactgctgtctttttgtttgtctgtgccctgccctgcccccagagttggagcctacagaagcacgcaggcctccttgagctgtggtgggctccacccagttggagcttcccggctgctttgtttacctaagcaagcctggacaatggtgggcgcccctcccccagcctcgccgctgccttgcagtttgatctcagactgctgtgctagcaatcagcgagactccgtggggtaggaccctcccagccaggtgcgggatataatctcgtggtgtgctgttttttaagcccgtcggaaaagcgcagtattcgggtgggagtgacccgattctccaggtgccatccgtcacccctttctttgattaggaaagggaactccctgaccccttgcacttcccgagtgaggcaatgcctcgccctgcttcggcttgtgcacggtgcgcgcacccactgacctgcgcctactgtctggcactccctagtgagatgaacccagtacctcagatggaaatgcagaaatcacctgtcttctgcgtcgctcaggctgggagctgtagaccggagctgttcctattcggccatcttggctcctcctgttgtaaagattcataaagttgatagattttaaatccttggaactgtgccttgtatatggtgaagaatagaaaagtgccatctttcattattttcaccaatagtaataaagcacaattgtatagtaaacttgtaatatagtatatgctcaataaattgttaattaacttttgtgttcatttcctagtgcatatatatcactaagggaattgatactaatgtcattgcatgcattaatggtaacattaattatcttcttacacattgggcaaaaaaagaaaataccaggctgtcagaacatcttggcccagaaacctcccttcagcaaaaagacaaaaatgtgagtgaagagaatatgcctttgagaattgagagggttgcattttgcctattatgtatagagatttgccaatttccctttcacaaactatgacagtgacactgattctggatgagcaacctgcataatgcttcaggggcacatctcttcttctaaggctgcaggcttgccgatgagacagaacacagcctcaattccatctgctgtcatttatctgccaatatagatagcagatctctgtgggtcttggactgctcaaacgacacagtatattttagcaactgaaggggaaccacttgagatcactaaaggtggaaaacacctgatgacaccttcaatcgaaagaaatgagtatccaaaatctgaaacattaggccccacagtacaatggctctagtgacagataaaaaatactatttctaacccttatagaatgaacttgttttcaagagctcaaagaaaacttttatcacatttatcttccacttttaattaaaaagattatttctgaaatgctaaaacttttgttttattcatgttttagaggaaaggagaggaagagaaaccacctgttactttcttgatgctgtacctggcacctgcccttgattgaagatgagttttgcatggtgtctgaaccaaaaataacaagtcctttaaaaattattgtcctaaaaaccagcagatcaaactactttcttttttctcagaggattcacaaagtatattgtttggaaaggcaaagtcagtgaagaaaaaagaggaacgtccctaaatattggtgttgtcatttataatgtaagacttcactagaatgagattatctcaggtgtgaatggagaaaggtaggatgcatgcagtgtggaagcagccagattcaacacactaaaatcattaacacatatgtttgtgtagttgtgtgtaattttgagggggagaagaggaattttgcctttaattctcactccaaccacttgaccaataattgggaatcatctcttttatcccctatttttgccccttgttctatatgttatttttttgagatgttctttatcataaagtgcctttacgtaggcagtatataagcagtatgcaaaattgagtccccatctctggcattgatctcaaagtcctttttttgttgtcaaatacctttgaatctgtgtcttcaaactctgcttgggttcactcaaatcagtatatttctttccatatgtaggtcttttgatttttgtcctaggttgactctttcctgagttcccttttacatcagaaattaacattttcctaattatccagtctagaaattttagtcatcattactttttcttttcattcatttttaatatccaatccatcctcaggttcaattaatcctttcttcaaactctacttcccctgtctttcattcttcagctgagttcacatcacataggtcctcatccattcatgccaggacttcgacagcagatactaacaggcatcaacctccagactcgttaaattaatcctacacactatttccaggtgacttactgaaagtcttcatttgatcctgtcactctccctttcaggactcttccagcaggtcacaactcacatatctgcaggagccaggagctattcaaatggagaaggcagggggatcctgggcaaggagggtatagatatatcctcacctgcatgcgcagtgacttctgagctcctcacagttgttatcatgtgaaaatataggccagggttggcaggctttctgatttttcaagagaacacagaaattagacttttaaaaagttgattcaataaatatgacaaggtatattagggttctctggaagaacagaattaatggaatatatatatatatatatatagacacacacacatatatataaagggtagtttattaagtattaactcacgtaatcacaacgttccacaataggccatctgtaggctgagaagcaaggagagccagtccaagttccaaaactgaagaacttggagtccaatatttcagagaaggaagcatccagcatgggagaaagatgtaggctgggaggctaggccagtctttcttttcacatgtttctgcctgcttatattctagcagcgctggcagctaattagattgtgcccacccagattaagagtgggtctgcacactgactcaaatgttaatcttctttggcaacaccctcacagacacacccaggatcaatactttgtatccttccatccactcaagttcacactcaggattatcacagaaggcatactatgttctgagctttcttctctgtactgtaaaaaaaaatacagcagtgaatgaaacagacaaaaattctacccttgtggagtttatattccagctgggagtgaaagatgaaaataatttatatattatatatatatgtaatatatagaaatatatatttatttatatatctatatttaaaaatatgtatggggaagattttgtgataaataccatgaagaaaagtgtattagagaagaggttaacgaatgtgtgtgtggtgggtggtggaattttaagtggtgttaggaaagacctcattcagaaggtagcatgtgagcaaacatgaaggaggtacaaaaagtcctcctgccatcatggagggacagtaagaaggtcctggtggctggagtgaagtagcaaagtggagaataagggaaaaagttggagatgaaacagaaggggactcagagctctattcatcttactagtggctttgccttattaaacaaagacctttaaacagatgttaacaagatccctctgactcctaatttggagatgactttaggggaataagggaagaaagagagatcagtgagaagcagaattctttttttcagggtctttctcattgttgttctcactaccatcatcctttggacagacaggtactctttttaagtcaatttgatctaaatgtgggttttaaaaaaatccttttctttgtttaacagctgagacaaagcaggaattttaaagcaacactttactgacaaactatgtagaatcaaagtaacatgaaactagataatttgttctatcataggagatatcttattcaaatgaagtcccctaggagaaactcttcttctgactccctcttcacactggacagcagaggccatctttaactttcccacaagagagggctccacaagacatagtcattactcaagagattgagaatcaagacagagaagtttagtctcctcctatgcttacttaaggctcacctccttaactctgatttcctctctgggaaatctctattcctctggtgactgtatactgggatttagtacaacatttagggaagtgcaacctactcaaaatatccaaatatagcaccataattctaacactctaataagaggcacatccacgtattttcaagggtggggaaagatcattaaataacagtatgagttatattatgttctcagtaaatattagttaccttttcttcctcttggagtgacttttaccaccctctgtaactcatctagccttatctaatgggaggccattttattttgggatggcatgactacataatttcaagctatttcttatgttatttgccgcctcttaaatatcttccccttacctccttctcatacaaaccttaaagttcttcataagtcacaacaacttataaggtcttttacctaactgaaccgatgtcttctctttgctgtacatttacatgtctataacaatcatttttcatttaaatatgaaactcttggatataaaaatattaacttgaaaaatagtaaccctgatttgctctttatactttaacaccttttgtttctttgtttataaatccactgtgcaaagctgtttatgcagcagaaatttagtaaacattctgtgaatgtctgaaacatccattcatcaatccactcacacaaaaacattaacatatactttgtcatgcattgttagatgttcaagcatgaaaatcaaacagtagtgaagaataatttattgtaaatattatttttcagggaagagaacactttagaaataacttcttgagaaattggtttgggaaaatagtatatccaaaattagagagcgccatcttgtgggcaagtgagtatctcacacaaataataactattataagttgcaaaaatagaatttcttctctttttttcttacaattcaaatctcctttttactgtaaatatttgtattgatgcataataattatacatatttaggaggtacatgtgatattttgattcatgcatacaatgtgtgatgatcaaatcagggtatttaagataaccatcacctcaaacgattattattttttgtgttgggaacacttcagctcttccagatattttgaaatatacaataaattattgttagctatagtcacctttctgtgttatcgaacactagaacttatttcttctatctaactatatgcttgtacccattaactaacctcttttcatcccacctctctcttcccagcctctggtaaccatcattctactctctacctccaagagatccactgttttagctcccacatatgagtgacaacatgccatatctgtctttctgtgcctggctcatttcacttattgtaatgacctccagttccatcaaggacacttaggttgattccatatcttggctattgtgaatagtgctgcaataaacatgggggtgcaggtgtacttttaatatactgatttcctttcctttgaataaattcctagtggtgggattgctggatcatatgatagttttatttttagttttttgagaaacttccatactgttttctattatggctgtactaatatacattcccatcgtcagtgtataggagttctcttttcccagcacccttcccagcatcaaataaaatcttttaaagaggctctgtctgtcctagctgaagaactgaaaatatatattaaaattttatataattaatgatattttaaacaatccttagaaactaattgtaatatttacaatttacttttaaatttcttgaatagctaaaaatgaaggctcagcaaagaaattactaaatatcataaacatgacatacttttcataagaaagcttataaaactgttaatgaaaaaggagacagaattcttagagattatctctttaaggggtctatcactttttgggtatctcagggtgctttgaaaatttgactagatcaaatctctcttgaaaaatgtaaatgtacacacaatttttcatatagtttcaggggcttcaccaactcccctgcggttgactcatgaacccattcatgaacttcatattttaaatacttacattttacataatatacaattaaagtctagaaggtttgggggtaaaagctaaaatttgattccattatctcttcatccccaaaacctcatgctcacacaattttataagattgatatagatagatcaaatcatgatgaaatatatttgctacatcgtttgagttcctaagctaaatcttaaaacttatagtttctaggctattaatgttccttacatcaacaaaaataaatatttaatattaggttcatgtcattcatggtatatctgtcacaaatacccttgatgtccattctatccaaaataaaagatgttattatggatttccttctttttcagggctgggtagaattctagtgtgtgagtgtgtgtgtgtgtgtgtgtgtaccacattttctttatccattcattgttgatgaacacttaggttgattctgtatctttgctattgtaaataatgctataatgaacatgggagtgcaaatatctttttgacacactgatttcacttcctttggatatatacctagtagtgaaactgctggataatatggtagtactatttttagcttttaaagaacctcgatgctgttttccataatggctatgtgaatatacattcccaccaacagtgtaaacatcttcccttttctccacatccttgccatctttcatcttttttgtactaacaggtatgagttgatatctcattgtggttttagtttgcatttccttgattattaagtgatgttgaacatttttttcatatacctgttggccattggtatggcttcttttgagaaacatctgtttagatccttttcttgttttttaatcaagttatttgttttcatactattgacctttttgagttccttatatattttggaaatcctgtcatttgggatcacatggatgaatctggatgacgttatgttaagtgaaataagtcaggcacagaatgacaaccaccacatgatctcatttaaatgtgaaagctaaaaatgtcaaactcatagaaacagaataaaatggttgttaaccagggctgatgggtgggggctgaagactggggcaatgttagtcaaaggacacaaaatttcagttaaacaggaggaataagttccagagatctattgtacctcagggtgactatagttaacaacaatacattgcatacttgaaaatagctaaaagagtagatttttagtgatcttgccacaaaaaaagataagtttgtgaggtaatgtatatattaattagcttgatttagccacttcacaatgtatacatctatgtaaataaaatgttttacatcataaatatatacattcttatttgtcaatttttaaatatatatataccttttagaattacagcttagccttgggttaatgaagtcatgacagtacgaggtttataaaactgaacaaagaatcctaaccatacgccaccctaactatggaaatacaatggaactattagttttctgtttcctctttctttctcattgagaaatcatgtcccttcataaaatccatttctctgtgtcagatcattggagctctttttttctccattattatttataatagttagtcttattcatctcttgctagtatgaaccttagtaacctaggttagtatttcccaaagtaggttttgtggaatgctaatatcaacaggtactacctgcaaaatggttgcatggtcaaataagctgagcttcataaaattaaactgatatattactggaagctaaataaatattgtaaatatccaggaaggagatacataggcaaaatattccaaactttattaaatagttaactttttgtttgcttacagagtaatggggttgggtgctccacagagaacattatggcacatgctgaactagagataaaaaagatagatttaaaaatatatgcagattgcttggacaaatttcagcaggatagtgagaaattgatttctagtgtagaatattctgggaaatgagatttttttacattacgtgatcctaattcaaatattatgattaattttaagtaagcaggcaatttgatgtaatggagaaagcactcacctgaaacagagttaacatgttttattccttggtacagtcatgctggtttttaagtgtttagcaattcattttacctctccagctaaggtaaaggaattcttgtaggagtaatagaagccctgtgattagtataaaacttagattaagatgctttgtgcagcaattcccatggcatatttctttttgtcttttctctttctctttctttccctccctccctccctccctcccttcctcctgcgctgccctgcccttcttttctttttctttctttctttcttgacaaggtcctgctttgtgccccaggctggagtacctgggctcaagctatcctcccacctcagcctcccagaaatcctgggattgcagacatgagccaccatgcccaggcccaagtcatattctaaaacatggcttactctgatattaactgccgtctacaggggaatggtctaattactctgcaaatgctctccaccttctagaatagtcacattccaattagtatatttaaagctcttagaagtcacgtaataaaaagaaatattttctttaagattttgaagccatatttacaaattatttgactctctagtctttttcttgtttttattattcaactggactcttaacatctcaaaaactagtattcaatgtaacagtttggaaaatgttcttataccttttctacttttaatagataaaattgtttttaattcatgccaacagagatgaaccaacaatctaaaagaatggactcctaatcaattgtagtgaatggaccatatgttcatattatctgtaattaaatggaggaatttaaaaggaaaggtgtgagaatggaagagaaggctgcctccccacatcctatccaaggctcctgtttctacccgcacaccctaccacagaaatacccaagatttattttctagagaaatgttctcagaaagggtcaggactctgagagagaagatgtagcaccctgcagggatgaggtgtggggctgaaacaaggaatgaagggaatgtctgtggtgcagatctggttccctgagatactccgagatagatagagattgggatgcagggtgtttgtggggaaatgttctcagtgtgagcaccacaggaagaagagtaggaacagggttaaaggctcaatggaggcctcttctggttcagttggggtttctaaaacttagaggaaggggttaggactctatactatctccttcccgtttatcaaatagccattgtctgcagactgctctgtataaatgggtataatcttgggcaagagcagtataccctctactggagaaacacatgctgaggggattctgggcagtgcatttcaacatccagaagagtcagcatcatgaatgctgaaaccttgcctcctaccccaccctctacctaaaatgaaagtaatcagattaatgataaattacttaaaaaaatagatgctggagtacaatagagtaatggcttcaatattttgaaggaatttacatttcaacatagactcctttagcaagtcaaactatgaactagtgtaaagacagaataaagccatctttagtgatgcaagatccaaaaaatgtaaaatattaatactattcacttcatttgccacttgagcttctataaaatgtgacccacaaaaagcaggaagctatcaaaaaggaaatcatgagatccaataatcaacacgggaaataacagaaagaatgcttaggatgtcagatttctagcgggcctagaaagcaactagctgagaagtacagattgaagcaagagtacaaggtgttgaggaggaggctgaaaagagaaaatgaaattgatagattatccaatttgctagagcatctgagaggggtggcagatatgagtaccatttggaaaagaaccaaagcaattattaactactagcaaaacagaagttgagccgtaaagcaaatatgtatatattacatacatagtaaataagatttatatatagtaaaaatatgtaaacagtgattgttaatttaactaaaaattgtgatgtaactaggtgaaaaaagggaactggagatcagtataagataattaaatgtttattatgataagaaatgaatagataatggctaaaaaaatgaaaatcaagaaaaaaaaacccagtataagcatattacttagaattatagagttaattaccagcagaaacaaaatgacttgagaaagagcattcacaatgaatatatatagtatagttttgcagactgttttttgaataaggttttcagtataattttaaaattatatgtgcataatttctctatttatcctgatgggtgagttaaattgccctgacaacctctaaatcttgtaacaacaaagatgatagtgattgttgtttcccatactacatatcatcgacagggagctctgctgcacagcctcctcactctggtacagaaactgacagagttaccatcatggactttgttgatccttctggcagaaggagaaaggggaagagatggagagtctcacaccagcgaatcaacgcttggctgctgattggccagaattagtcacgtggctccattcaactacaagagggttattaagtgcatctacatgtgtcctgagggtggagagctacaaagagagagccagtatcgctaatggttgcctcaatttctctcataataattgttaagtaaaaataaaatagggcttggcgcagtggctcacgcctataatcctagcactttgggaggcccaggtgggaggattgctcgagtccaggagttcatgaccagcctgggtaacttggcaagacaccgtctcctcaaaaaataaaaaaaactaaaaaaataaaaaaatagccaggtgtggtggcatgggcctgtagtctcagctacttggaaagctgaggcaggaggattgcttgagtccaggaagttgagactgcagtgagccgtgtttgcaccactcgctcttcagtttgggtgacagagggagaccctatctcaaaacaaatacaaaaacaaaaacaaaaatggtttacttctagctaaaaatttaattaaaaattaaaaattcctatggataatcagcatgtaaatatttgtgtgataaatatgtaggtatataagcaaaatatgtatataaacaaatatacatatggattatatatgtataatttatatttttatatttggttttttcatatgtgtattattgagtccttaaacaaatgttttttgaatagcttctatttaccaggcattgttccaggttctgggtattcaatagtgaacaaaacagacacccctatttctgtgtagcttatatggagtggtagggacagagagactcagtaagcatagtaaataaatacattgtgtagcgtcttagaaggctctcagtgctagggaacaaatagtgcaatagcaggggagttcaatacagaggctgagaatatggttagaatttgcaatagggaaatcaggttagaaagggccctttgaggcaaggattgaaggggagtggggatagattcgtgggcaaatgggcagggaatgcaaatatcctgagactggagcaggcttgcgatttttccaggaatggctggaaggctagtgaggctgcagtgaggggacataagtgagatcgtgaatggggacataatagggggcatcatgtgaatatatgggatgtagagaccgtgctaaagactgccatactctcagttaattgattgaactctgagtgaaacacttgaatttacaccgggaaataaattgcccagcatctagaagatgattaatatttcatgtaaaccaacttggtcacactatgaagatggaaatgtaaaacttgttacttttctatccattattaattgcttaaagctcttccatgctttagataccgcactaagcatttatgtttcagcaaagtattggcataaaataaagcttacaggatggtgtgaaggcaatattttttgagtgtctacagcatgccacaaaatgacttcaatgcttagaataattgaattacataaatataatgtccccattttataggcgaaaatactgaggctcaacagacataaaatggcttgagttaccaggctacagtagaactaggatttcagtccaggtcagtctgaccccaaaaccttttcttttttcattgtttggatttagcacccccaaaaatgtcttgtaatgcagatttcctgggtccagggaattgtttaagtttttgttctaaaaactttcttatgaagcagattacatatggaaaatgaccctatggactatgagaattggcctttagagaatgtcactgccagccctgttggtatctataagaaccaataagcattatttacagagagtgatatacacagtgataattaagaaataactatatttatgatgacaattttgccaaatttactagaaaaaaataaaatatcctctgatttgagatttattgttcttttcttttgcaggtaagtttggaaattttttttgcttgtggaatagaggtatggtatcacttttttctgaattttattttaattgcttttaacattgagcacctttcataagtaatatgtttcaccacccattcggttgttgttgttgtatatatttggaaagtaacattgtgggtttgcgttatttgattcagaaattttacatatgtgattccatatggtaaatctatgcagtgtttgtatttgggtttgtgtttaaattatttctgtgtcaagtataaggaagaggattgtagtgcggggtctgtgtcagggaaatgggggactgtaaagaacagaggaaagaatatgcatgtaatgagaggttgaaaggctgagaagggcagctccaggcatgtaatctacaatggccatgaatgcatgtcatgaggaaaagatgccttttcaggaacaaaataatcaactgaaaactgttttcattcacttttctaagcccctagttttttgttttctcctattattgtgcaaaatttctggccagactattgctgacatgtacctttgaataaaaaaaatggctgtaactattctgaaacatgttaagttagaaagcaataaaatagatccacttcctggaaaaaagctcttattaactatatgtcaactatttcagataaggagtaggaagtttcagtaaagcttctagatacacaaaagagaggataaaatattagagggacttagaaagacgtgatatttgcactgaggaaagaaggtagcctgtaagttgaccacataggaccacggctttattattgtgcaccgtgctttcattagtatataaaagaggtgattgtgtgagatttaaatcaagcatgaacttaaactaaattccatattaattataaacggtatgtttactttattcaaaaaaagatatatgtttctcaaaataattgcaaatattattattaattatataaaaataaagaggaatgaggatactaatctactcacctaagttctagctaagagatgaggtagcaaaggaggaagaagttcttcagttcctggtcttgatgggtaaagcgatttgatctcattatattctctccaatataatcatattaatatcgaagtcatcagaacggagttgatattatcaagctaagtaaatattagaaaaataaaaattaacaaatggtttcactaaaactgcaaagtttgtacctggaccacaaagctaatggactggcctacaatggtctttgttttaactagtattccgggggttgatggaaagggagtggaattaaagggcattgtaaaatgtcatggcatccaatctaattatcagagctctagctccagggtcagcaaactttttctgtgacaagccagatagtaaatattttagccttttggggccacaagaactctgtagtaactactcaactctgctgttgcagagcaaatgcagttatctgtagacaatctgtaatgaatgagcataatatgttccaataaactttatttacaaaatgaaaaaaagtagtgggcaggatttgctctgtggtagttttccaacccctacctagctccctttgaaataaaaaaaaaattaagtaaactttagagattttggaacaagatgtatgttggcccccttcagatacagataaacacttggtctaagaatgaaatgttgttcaactggagttcagaaacaagatatgaacttctcaaaagctttgatgaatttaaacactagagggcacaaaaggacatttttaagtcaaggacctcttgtaaacagaacactacaattatgagaaactgcctgaagtagagcgatgtgacctcaatgtgcataatttgtttgaaatgtcagcctgtagctcttgtgacctcactgaccacaaaaacttgaagtggttgaccaccttcatgttgctgtaataatagccacatgtctttcttctttttttcctacttctttctcacttctttctctctcttttttttttttttttttgattgcttttggccctttcataaaatatggccaaaattgaggatttatatgatgggattttttttcatttcctaatagtttttttaattgctttagattctaattttcatgtggtgagtcctatttgtagtaaataagttattttgaattatgttgtgtcaatcttttataaaatcataataaaataatgcatgttatttatgcatatgatttatgcatataataatgtatattgacagatgtcatctgttacattgatttatgaactaatttgaaagttttatttcagaaaaatgcttaaaaatcagcagaagcttgaagcctcaaaattactcctaccctttaacacatggacacaaagatggtaacagtagacactgaggattccaaaagccaggaggggaaaggggaataagggaggaaactctacctactgggtacaatgctgaccacctgggtgatgggatcagcactgccccaaacctcagcatcacgcaatatactcatgtaacaaacctgtacatgtagcccctaaatctaaaataaacattgatatttttaaaatcctacctcttaatttagtaattctgcttgtagatatttggattgtggaagtaatttgggatattaaaatatttatattcaaagatattcaccgtaaaaatacctataatattgagaacctaggtatattctatgtatttcacatgaactaatgtttaaataaattttcatattagacccagccaatagaatcttgtcaaccattaaatatattttcaaatgacattaagtgatagagaaaatggcttatagtaaaccatgaatgcaaagcagaatccaaaaattatgtacatcaaatctcaattgaatgttaaaattagatgcgtaaatatatgtatatacatataaaaataaagaaaatgagccagatttacaagttgcctctcggtatagatgatttttaaaaaaatttaattttctgaattttccaaatttctatcatgaatattcatcattcatatggtcataaaaaataagtattattcaaacagaaaactatttttgcattctgacagcacttttttaggtgtgattcttagatcagtggtgctaaaagtcagaaggttataaggaaattatttatgtatcaggcaatcaatttaaatgaattattgattgttacgcagacacatcattagagtcacttttttagccctgggatgggatgatttgtctcaggtttgggtgttgtggcttagttgccgtgcactaggcagtgaagaccaggaaggaacaagggcctgctggagaggcctgcagtgctgatattgaacatggacttccctgtaagctccctggactgtggtaaagcaggacacatcacacacacacacacacacacacaaacacacacacgtggacacacacactcatgctcctctatcctttttctcttctaaatctgctttctgcccttgcctttccctataaatggatgtgtgtggagaggagctggagagacagcaggggtctgaaggatgctaacttggactttttcctgagcaaagaattccttaagaatgacctggtataaaaattttgaagaaatctcataaataatatgggcaaaaatgtgacagcaatgtggcacaatgcaaaagcttgtcactagtttcagcccagcttttcctcgtgattgttttgagtagcatgaattatcctctaaaatgttggtttttattcctttttcattttgtacaaacatacctaaaagggtgaacatagtataagcaaagacacaacgttggaactataaggaataattttttcttaattcactatgtatttttctaacacttttcttggagcttttaatccttagaacctaggagatggaggactatacactcgggtttacttttctttcattttcttcttctgaattcttttttttaacttttaagttcaggggtacatgtgcaggtttgttatataggtaaacttgggtcacaggggcttcttgtacacattattttgtcacccaagtattaagcctactacctattagttttcctgatcctctccctcctcccaccttctaccctctggtaggccctagtgtgtgttgttcccctctttgtgtccatgtgttcacatcaattagctcccactaataagtgagaacatatggtatttggttttctgttcttgcattagtttgctaaagataatggcctccagctgtatccatgttcctgcaaaggacatgatctcattcttttttatggctgcagagtattccatggtgtgtatgcaccacatttttttttatccagtctatcattgatgggcgtttaggttaattctatgtctttgctattgtgaatagtgctgcaatgatcatacacatgcctgtgtcattataatagaataatttctattcctttgggtatacacccagtaatgggattgctgggtcaaatggtatttcttttttaggtctttgaggaattgccacactgtcttctacaattgttgaactaatttacactcccaccaacagtgtataagttgactttttaatactagccattctgactggtgtgagatggtatttcattgtggttttgatttgcatttctctaatgatgagtgatgttgaagactttttcatatgattgttggctgcatgtatgtcttttgaaaagtgcctgttcatgtcctttgcccactttttaatggggttgttttttcttgtaaatttgtttaagttccttatagatgctagatattagacctttgttgaatagtttgcaaaaattttctcccattttataggctcactctgttgacagcttcctttcctgtgcaagagctctttagtttaattagatctcatttgtcaatttttgcctttgttgcaattggttttggtgtctttgtcatgacatattttttttttttttttgagatgggtgtctcactctgtcacccaggctggagtgcagtggcatgatctcagctcactgcaacctcctcctcctgggttcacgccgttctcctacctcagtctcctgagtagctgggactacaggcgcccgccaccacgcccagctgattttttgtatttttagtagagacagggtttcactgtgttagccatgatggtctcgatctcctgacctcgtgatctgcctgcctcagcctcccaaagtgctgggattacaggtgtgagccaccacacctggcctgtcaggacatcttcacctgttcctgtgtccaagatggtattgcctaggttgtcttctgggatttttatagctttgggttttacatttaactatttaatacatcttgagttaagttttgtatatggtataaagaaggggtccaatcttctgcatatagttagccagctatctcagcatcatttattgaatagggaatcttttctccaatgcttgtttttgttaggtttgtcacagatcagatagttgtaggtatatggtcttattcctaggttctctatcctgttccatttgtctatgtgtctgtttttgtaccagtaccatgccgttttggttactgtggccctgtagtatagtttgaagttgggtggcatgatgcctctagctttgttctttttgctgaggattgccttagctattcgggctcttttttggttccatatgaattttaaaatagttttttctagttctgtgaagaatctcagtggtaatttattaaaaatagcactgaatctataaattgcttcaggcagtatggccattttaacaatatggattctttctgtccatgatcatggaatgtttttctatttttttgtgtcgtctctcatttgtttgagcagtgttatgtagttctccttgtagagatttttcacctccctggttatctgtattcctaggtattttattctttttgtggtgattgtgaatgggattgcattcctgatttggctctcagcttgactattgttggtgtgtaggaatgctagttatttttgcacattaatttcatatcctgaaactttgctgaagttgtttatcagtttaagaagcttttgggctgagattatgtggttttctagatataggatcgtgtaatctgcaaactgggatagtttgacttcctctcttcctgtttgaatgtgctttatttctttctcttatctaactgccctagccaggacttccaaaatgttgaataggaaaggcgagagagggcatccttgtcttgtgcccattttcaatggtaatacttccagcttctgcccattcagtatgatgttgactgtgggtatatcattgatggctcttattttttgagggctgttccttcaatacctagtttattgagagtttttaacatgaagcgatcttgaattttatcaaaggcattttccacatcttttgagataatcatgtgttttttgtctttagttctgtttatgtgatgaatcacatttattgatttgcatatgttgaaccaaccttgcatctcaaggatgaagcctacttgattgtggtggataagctttttgatgtgatactggatttggtttgccagtattttatggaggattcttgcatcaatgttcatcaagaatattggtctgagttttaaatttttgttatatttctaccaggtatttgtctcaggaagatgctggccttgtagaatgagttagggaggagtccatccttctcagttttggggaatagtttcagcaggaatggtaccatctcttctttgtacatctggtagaattcagctgtgaatcagtctggtcctggggtttttttggttggtaggctatttattactgactcaatttcagtgctttttattagtccattcagggattcagcttcttcctgattcagtcttgggagagtatgtatgtccaggaatttatccatttcttctagtttttctagtttatgtgcataaaggtgttcataatactctctgatggttgtttgtatttctgtggggtcagtggtaatatcccccttatcatttctgattgtgtttatttgaatcttctctcttttcttctttattaatctagctggtggtctatgtagtttattaattttttcaaaaaaagaacaactcctggattcactgatcttttgaatggttttctgtgtctcaatattcttcagttcagctctgattttggttatttcttgtcatctgctggctttggaatttatttgctcttggttctctagttcttttagttgtgatgttaggctgttgacttgagatctttctaactttttgatttgggcatttcatgctataaatgtctgtcctaacactgccttagctattttccagaggttctggtatgttgtatctttgttctcatttgtttcaaaaaccttattgatttctgcttttatttcattatttacccaaaaggcattcaggatttcaggagaaaaggcattcaatttccatgtaattgcatggttttgagtgaatttcttagccttagcttctaatttgattgcactctggtctgagagattgttcattattatttcagttcttttgcatttgctgagtagtgttttacttctgattatgtgatcaattttagagtatgtggcatgtggcaatgagaagaatgtatattctgttgttttggggtggagacttctgtagatatctatcagatccatttgttccagtgctaagttcaagtcctgaatatcttaatttcctgtcttgatgatatatctaatattttcagtgatatgttaaagtctcctgctattattgtgtgggagtctaggtctctttggaggtctctaagaacttgctttatgaatctgagtgtttctctctgttgggtgtgtatatatttaggataattagatcttcttgttgaattgaaccctttaccatgatgtaatgcccttctttgtcttttttatctttgttggtttaaagtcttttttgtcagaaactaggattgcaacccctgcttttttctgtttttcatttgcttggtagattttcctccatccctttattttgagcctatgtgtatcattgcatgtgagatgggtctcttgaagacagcataccagtgagtctcgattctttatccagcttgccactctgtgtcttttaattgaggcatttagtccatttacatttaaggttaatattgttatgtgtgaatttgattctgtcatcatgatgttagctggttattttgcagacttgtttatatggttgttttatagagtcattggtctgtacacttcagtgtgtttttgtagtgtctggtaatggtctttcctttctatatttagtgtttctttcaggagttcttgtaaggcatgtctggtggtaacaaattccctcagtatttgcttgtctgaacaggatattatttccccttcacttatgatgcttagtttggccagatatgaaattgttggttggaatttctttttaagaattgtgaatattggccctcaatcttttctggcttgtagagtttctgctgagaggtccacagttagtctgatgggcttccttttgtaggtgaccttacctttctagctgcctttaacatgttttctttgatttcaaccttggagaatctaatgattgtgtgtcttggggatgaccttcttgtgaagtaccttaccaggagtttctgcatttcctgaatttaaatgttggcctctctaactaggttagggaagttctcatggataacactctgaaatatgttttccaagttggcttcattctcctcatgtatttcagggacaccaatgagtcgtagattcagtctctttacataatctcatatttctcggttttgttcattccttttcattctgttttctctattcttgtctgactgtcttattttagaaagccagttttcaagctctgagatttctgagattttttcctccacttaggctgttctgttattagtacttgtaattacattatgaaattctaataatgttttcagttctatcaggttggtgacattcttgtctatactggctgtttgtctgtcagttcctgcattgttttatcatgatttttagcttccttccgttgggtttcaacatactcctgtacttcaatgatcttcattccaatccatattttgaattctatttctgtcatttcagccatctcagcctggtttagaagcttgctttagaagggacacggttgtttggaggaaaaaaggcactctggccttttgagttttcagggttcttgtgctgattctttctcatctttgtggacttttctacctttaatgtttgaggttgctgacatttgaatgttttttttttccttttatcctatttgatgaccttgagggtttgattgtggtattaggtggattcagctgattggcttcatttctggaagattttaggggtccaacactcagctcccaacttctggactgtgtgcactaactctgggggacttgtatgaggcccaaactttgtcttctcattcttcaagttttggaatccactcagctaggggtgctgagatgggacagctgcagtgaagtgctagtgggtgtgggggtgcctgcctccttgcagatgttcaccagagtggcagaggcaatgcagcttacagaggtgggcaggaggcccttgctggagcctgtgtgcacagtcacactggaggtggtgttggctgggggtagggtggtggcaggcacaggtctgaatgccttctctgtgccccacaagcaggagtgatagctcagggtaggggaggattcactgttctctgtacagcccacgtgtttacttttcaaataatttgatgaactgagtgaaaatattgaatttagactagctgatttcattaaactatgcttaaaacttcaatttatacaatttttttcttcattttaaaactttgaaccaaattggcttgtaacataaactaatagattcaattagttatttggaattattttcaaagatgtgtccaacattctagagtttaaagtttatatcctcaaattacaattgcttgtaaagtttactggtttatttcctcaaatgatcattgctggtttatgtatatgaaatattctcaaacatatcaaggtacagataaagctatgagacacgtaagcttcttctgttgtccattgggtaggtagagaaatggatgacttggcttatttaagctaattactaaaggaaatagagaagccttgagtcctttctggaacaaaacagaattaaatattcattacatgagggaaagcataatttagaacaaaataatgaaatttccctggagtctgtcttctaagaggtttgatggattcatttaacatacatttatttcactcctactgtgctgggcagtcccagggttatacagccccaggaggttcagagtccagtagaacatgagcatataccactctttttctttacaatactcctttagagaaaagaagactgcagtttgcattttgccctgggtaagaaacaaattagagatgtaaagaaactttgctaagcactacagatgcctttgacgtgtttattcccgttgactcataactgtgtctcaccagataacctatagtatattcataccgaaacttatctttttctaatactttagttattagtttttaggtaacctgaagaagaatgaatatgagcttttcatatctatagtaggttcacttccaatccagagaaaccatggacagacctttttttcagctaaacaaagtgtggtagtttaacatcgcagtaagatcaaaaaccaccttaactgagtatgaaaaatatttgatgatacagtagtcttcaaactaagtttaaaagatgcaaatagtacatatatgccagtacatatgccagtgtcttgaatactgggaaaaaggaggattcgagtgggggaaagttcacgacattgtctctctgcctctaatctttcctgctcaagtccttgcaagtagaatcaaaatatcaattgttctgaaattaattctgcttttattatttcactcccttgttcagagaaacttggtaagttttcacttctaaatggaacaaaggtcccactcctaacgtatcattcaagttccttcacagtccagtctcaacctttctttcctttcttttcctaactatcattgttcataatacagtaatataccctcccaggagtattcaatcttttggcttccctgggccacattggaagaattgtcttgggccccatataaaatacaccaatatgatagctgatgagcaaaaacaaaacaaaaagtctcatgatgttttaagatagtttatgaatttgtgttgggccacattcaaagccatcctgggccatgtagcccacaagccacgggttggacaagcttacaggtctaaactctgataatttcactacaccttggatattcatacttctggtgagcagaggctgcttacactttttataggccaatatcaatcataacgtttaagtgtttaataagtatcaatatttatctcatatggctctcagaacagtgaattaattcacttagcaaatatatattgaaccattaccactatctggccctattctagttgttggccaaacagcagtgaatcaacatgtctctcctctgaaagaatttaattttttgtggggaggatagtacaaaatatatgaaatacataaacacattcaaaatgtgtgtcgtgatggttagttctatgaaaaaaattagtgcagagtaaagaaatagtaatacgagtgtgattttagattaaaaagtcagaataggtatccctgtctgttaaactgacatttaaatcttaacaaaatgagtgaattatgcatttttccaaaggaagagtgtttcaagaaaaagaaatagcaagtgcaaagctccttaggaggaggcacattgtgtttaaggaacaggaagaagttgagtattgtgggaactgagtaagcaagaaagagaatagaaaaggaggccataaagagaggagagggcttttgaaaaccatggaaaagagtttggattttatcccaaatggagagggaaactagtaaagggttttgagcagagaaatggcatacattttcaaaggatcactctgggtgctctgtgaagaatagagtaggagcaagagtagaagcagggaaaatggttatgacgccactgcaatagccttggaaggagacagtagtgacttggacccgggtgatggcagtggagatggcgagaagtgatcagattctggcaatgttttgaaaccagagctaattgtgtttgatgacggatttttacatagagtgagagaaaaagagatgagtcaaagataattcaagggtttttggcctgaacaaattggaaatgtgtgtttttatttattgagcttgaggagttcaagggaggagtaggtttagtggtggggtggttctgtttgagcattttgagtttgatagtcctgtttgtggaaaatgcttggagtgctgccccatttccctccacccactatagagttcacctgaggctatggcagactcagtcagtttcccatctcaggcacctgggggctttctgcagtacaaaggagcctgctgagaccgtttacagaattttttaacattcccagtggcaacactccaacattgagggtccagagttggtgctcatataccccaggttccacattctccagtgggacagtcctgaggcatgtgtatatatggtcccacaaaaggtccctggggagattgggccccatctgcccctgcttattaatacacactgtattaacttttcttcctttgctatcccacttctccatcacctaactttgatttcctagaatcgccttcctgcctcttctccaaataaactacgcactccaatattttgcagtctccctggaaggaattaaacctaagactattaaatacccatatgtcaatctccaagaaggagattgatatactattctgaaaaccaggcaaaatgtcagggatggagatacagttgggaggcgttagtctttttcacaagcctattcaaaagcccattgcacaagcactagatatgtgtagattcctacacagacttgttaccgtccttgtctgcctcatgtcatctcttccacatgaatacaatgatactcatcaatgaatgctctgaactttcagcaaaggccacagtagaatttctagatagtagtagattgagaagtgatgacaatttgattggaagctaagggatcttggggacttgtcttgaatttgcatttacatagaaagcacatcgtttttatgtttgacacatatttatttgtggtgggtttggaaaaccttgtagcggttatggaggggcaccccaacccatcctttggtgttgccattgctttttaattatgatttgtgctaagccacacattctcattttacctagctcagggttctaagcatgtttttcatgatggtttggttaggaaagtgagtagcaatgaatgagctcctcaataaatacatagcacagacactgacaggcaaagtgaagtttgtaatcacttcccaatcaattgttcaactgaatgtgagaagaaatcattttctctcctgttttgagtcagaatatcacataaagcacaactcttcctgcatacattgtatcatattccacagtaatttacttttttgcaagaagtatccaaaatttggtttttcctgctgagcagttatccagataattgcaaatcagtggaatcatttacatgaataaagatttttattctaattaacgtgctaaatcaagcacaccaaatgtctctaattcttatattactcaaatggcaatatttttgtcagtgactatcatatgaaatttcaggtgcctaatgcattttcaaatggcactcataagcatactaacgttttataaataaatgtctccatatttttaagatgaatggacaatttttgatttttaatgtagtccccaattttcaatttttcaattttcatttaccgaatggagaaacagcattcatcagagcaaaagagcaagtttcacaagtcatgggaacaaacatagatgctaatttcctattttaggaagttctttttaaagtattatcattaagaagcacaactctgtggaatatttatgtgcacatttaataatagagaattcggatgtcaagtctgtgtgttactcatacccatacatgcatcctcaaaaagccttggaagttaatcctcagctgatgaaagctaagcaattgctctggaaggatacttgaagtttttggctcttggggtgaaggtacagtcacgaaaacctctcttcacaagagggcgctgtgcaaacagctagctcctcgtgaaggaaaattgccttgcagactggcacgaagtggatttctttacatctattaagtgctctgctcttcataaaggaaaatttccttgcaaactggcacgaagtggatttctttacatctactaagagctctgcttctttctctctctcttgctttttccttgccatgcctcttcttaggctctgtaaggcagacttcttgtcttctctagttatgcttctgcaaactgcatcatgctgattctattaatgatttgattttaaataataccatcataggtgttaaatgatgtgtatgcctatctggcttctcaggacttctctctcactactttacatctcaccaatgtgtaaaatatctatgagacatctttaatttaatatgattcaaaagtctttactcttgacctttgtttgaagtctaatcaactaaaaacctaaaattcctggtgggaaaaaaagaaacttgactactctagttttttaataacatgtatttcatttattctgattataaaagtcatctttatttattgtagaaaatataaacattatggaaaataaaatttaaaaacatctatcattctattacccagaaataacttgatcaacattttggtgcatattttaatgaatagatttttaaatgagaaatgcttttcaggagtaattagattctacttagtattgacaattttataatatgcttttaaacaaagtattaacattaacttttttggaaaatgccactttctgctacttatagctgtattggctattttctcagaacttctgctgtaatgagtttatactagagttgcaaatacacgttctttgaatgtacttgaggagtcgatagtctgaatctgagattttccacagctcttggagcacctgagaacacactagcttcttccacgattctgcagtacttgctccttcctgataggatgcctttgtaagcgtacaactccaaacatgggctgagtgttcagtaatcatttgtgttgagttcttcagtttcatggagactaaaattaggttttctctgtcactcttgtaatgtcatctgaccttgacctgcatttcaaattgctgagaagttagcaagctgacttttacactaggcacatcagaaataattgattaaaaatagagttattgaagttgaatttttttcatttatagaaaagtacaatgtcttgttcatgacaaacaaggcctaacatttatataatgttcatttaaaatatatcaaaagaaaacaaaataataaaacccacagaaaacccaaaaacaactcacctattaaaacatctcttgatttataaatattatagtttagtttgtacaatatcagtaactgtggaaagctcccaattatctcattcccaagtgcttgactgactcataacttaccaacaattttcttatttcagagaatcccaaaaacatattacctaggactaacctggaataaaacttcatggttgatagcttttatcaattaaatgggtattgatttggataactcataatcttgagcatatctttagatttactttttatcctgaatttatttttgttagtaagatttagaaattcagatttattttgtgctttatatgacatagaaaaaaacaaattgtctttcctgtacaaagtccacccttcaaaatagactccagaagaaaacatagagacttataacttaggttaaacataggcacaatcctaaatagtattcagatgagtcttacctgaataattgctcacctaatatgataatcacctgttaagaagcagtttcttaaatgtcactgttggaatctaaacagtagatacacaggtgttcactgtaaacttgtttcaatttttctgtatttttgaaaatgttcataataccatcttggggggaaaaagcctctttttgacatggcaagaaccatattctactgaaacagatcttatatgctctatcaagtttatattttagacatccctaattcagctcattctggactattccaggactgattgccctactaaggcatgcttatttttttctttatgtgtataagaaggattcaaagggaccgtttgtcagttttaatgtgtgagcactactgatatgttttattgagaaaaagcttactgccacagatcacagagatatttttccgaggtaagattcttgctggtttgcaagttttgtaaggaggcaccaggacccatctctgtacccccagccacggagcccttatttagacccacactgggctgaaatagaaacttctgtacaaatgtatctctcctgtgctctttccactttaacagaatagaaagaattgactggttgagcccaaatatttcccccaggccagtgttacaaactggcgtttcaccaaaaataactcatttgatatgtttttaatgttgatgatctgaaaaatcatcttcttgtttttgtttgtttgtttgtttttagagatagggtcttactctgtcagccaggctggagtgctggagttcagtggcacactcacaactcactgcagcctcgattcccaggttcaggtgattctcccacctcggcctcccaagtagctaggaccccaggcatgcaccaccatgcctggctaacttttctcttttttgtagagatgggatctagccatgtttcccaggctggtctccaactcctgggctcaagagatctgtccgccttggcctcccaaagtgctgggattacaggcatgagcttcatacctggctaccttcttcttaattatatacattttttcttaaataagagctcatgttattttttatttctataaatattttatattccttctcttcttattgccctgatactttaaataaacctaagcccagtcaaattttgtattacccttgagtttcagtttttggttcattcagccctaagttctctttgggcatgaattgttttcaccattgactactagcaggcagctggcatagcctgggacatgtgaggtgatgctaaacatgcatttgtgagtagaaggaaggaagaaaggagggaaggaaggaaggaaggtaggtaggaaggaaggaaggaaggtaggtgggtgggcaagagagagggaggaagaaaaaaaggaagggaggctggttggtttgattagctgttgaacaaaattccatatagaaagtagcttactagtctatatcttttagctctgtttatttcaaagctttgtgtgtttttgttagggtcacttatagaatatttagaaaaatacttgctgcctcatgcatttcaccatccagtgcctggtgagacctaaaagcccatagttataattttgtttctttgaccaaagtttgttttattttcaaatataaattcaatcccttaagactcacctatagcatatatatcaaacaaaaacacgtcaaatttaactcagaattttgctggataaatgattttactggatatcatctgaccaatgaaataacaattgtgtgttctcaaatttacttctacatttttaaggtagtaagtttaattaaaaatctctaatataaaaatggcttattctctaaaatttagaggtaagctaaagttttcatcaaggccccattatttagcactttccaaacttgggaaggtcacttaactccactgaaccagtagaaataaaattagtggtaacactgaaagcaaaaaccagaaccagtccaattgtcttattaataatagcctaattgtgtaaatgtctgttataaatttcttagctggttctgagagatagctagtaaatggcaccctaagttttatatattctgttacaaaacaaaaacaaataacaacaataagctgttttcttttgctgttactcaaacatctggatttctattgtagcccctagcacattgttacctttggttggatggactgaaaagtgttgtgatttttctcctatgtagaatattcagagggaaagtgcagggcagtgcacaatgcatacaaacattgacaggatcacttttcctcaagctgaactatactctaggcctcctctctctctagttaccacagttgaacccactcagcccctacttgcagcctcagtcccaccccaggctcacaggccaattttgtcctggaattaggaattgaaagatctcaggtaagccagccacaatggagacaagatttagagataagcaaaactgacttggactcacatgtctgtcatatattacctctgtggtgttagccaagttccttaacctctatgagtctcagatttctcatctataaagtggtgataataatgtctgctcgtgagttggaagattaagtaacatgtagatcttatacctgacaccaattgtttttcctgtgaaagttcaaaacttctcttatgatttaattcttcaaggaaggtgacctgacctttttcattcctgtatttacttatattccaggcatgtattggttaagatatacattttgcaattaagagggacctcaattttaacctcagatctgctactcattggctgtatgatcataggggcaagttacttcaacttcgtaagtcttcgtttcctcagtggtgatacagaataaaaataacacaaagcacacagataaattattatgaggataatatatagtataccctaaaattctgtgcagagtcttcagaacactttcatgttagttaccctattcagtcctctcaaaagctctttgcaatggctctctctcaaatgagaaccaaatggataagacattataactcagcaaggtcaataaacaccacagaataaacaccaaataagtggttgatatcatcatagtaaaatgaggaattagaaaagttaacccgacattatggtgatgtttggttcacaaactcattcagtgcacaggaagtgtccaagtaaggaaggggtctgaggatgacaggtactcaggaatgggaaagtttatgactgttggctccaacaaatggataaccagatttagcaagatattgaacagtcacggaaaaaatccacagcaccaaaatttagcacatgagatttttatttagggattcttggtattgggggtcttttttctttctcccaagggagtgattttgtttctcagcctagcaatttcatcactgcttttgcttatttgtaagcataattctaaaaagttgtaagaagccatttctgtccttatttggtacgtggccaacaataagggtagcatgagttggagtcagtgttgcaactggtttcccaattaaacaacctgtctctaggatcccataagttttcaaaaaataagtagaaacatttctatatttaggagaagcttagggttttgagcaatcgagaaattctatcacctaatttttgtaaaatttcttgccacctaattttttttagatcttgtaaacaaagttcttagagggttttaatgctgcaaataaaacattaacatttcttcatatgattaaccttcaagatataacagctaatattttattcttacacacatgggatataaagatttcaaatagagaaaagtgttatctatcaaaactgaggactgatattctttttgaaactgataaagtggtatgcctatttaccatgctcatgaagtaaccaattggcaatttttagaacttaaagatgtttctaacagtataaaaatagttttcctacctctcccaaaagcttacaaacatcagtagtgtgtgcctaaaattttgtccagttttcagaatgtttttatataaattgccttattcagccctctccaaaactctttgcaatggctctcaaatgagaaccaaatgggtaagacactgaaactcagcaaggtcaggcaacaatcttcaaggtcacatggcaagttcatggcataactgtgactctaatctctaatcccctatacagtgctgccctgaaaacttgcccaatggtattttgattaaaaaaattaattaatcaatcaaataggaaaaagaaactaaataagccctacctaaattacctgttctgaaatttctgcccctatttaggcacatataagaatataatgtaaatgctccatcttatttttaagatgccctgaaaatattggtttgtccatttattaaacaaacataattgtggtttttatgtctctagactgtttgctaagcactgagtacccagagggaaagcagatgttatccatgttctcatagtgtttaggtctatcaggggagccagataccaaataagtcattactaatgtgatgacattgacaaagaggaagtacaaagtgcagtggagacctcacctggtatggggaggcagggaagacttccggaggaagtgaatttcaagatgtaatcctatatccaccactccttcactcaccagtcaatagctaagtaggatttttatttaagactgtattcatgagtagaatattaaatagaaagaatttttatgacttttaaaatcttcatatacagagaattgaacaagacaatcagtgacaccagaagacttttacacacttgttagaaaattgtgtcaaattatttatttcaaatgattagtctacattgatttcaagatttttaaagaatttgagtctagaaatattttttgaatagttagaaaaatctcttaggaacttgtcagtcatttagtagatattcaataaacataaaatttattttcttttccttccatttcttcctccatgatttctttccttcaatcccatttatccaagtaggctttatccaacaaagctttagaaggagctttgttagtttagtgaatagaaaagcttgacttagttgttttccaaattgctaaaaaaaatcctaaaattaatgtagatggaaaccttaagtgtctagtaaaacattttgattcacaatcatagtcatattgattttttatcattatatttaagcatgcctcttattgattgttttagtctatatcctgattttagctctttaattacagtttgtgtctgtttgtgtcctgggtcatatatgagtaatggatgcaattgtagaagcttaaaacacagagcatgctttcccagtgttcttaagaccatggggtaccttcaattctgttaatgttttactgttgccaagtcttaaaataattgtctcccatttcagaacatggaataattgacctttcaatcaagtagactcatataaggtttagaatgaatatttgaaagcaattcaaagaaaattttggtattattttgcaacacttccattttgagaaataacttatagttgattttgataagtaatgtaataaaaatcattttttacatttacttgtactgaatggatattagttttaaggagtacacaagccccgttatcaaactgccttttgtcacactcttttgcaatgtatcattctgaagatagaattacaacgacaccctcatcagaagtagatggtaaataacagtctgttatttgcttccacattaacttctgctggctttgagtctgtaaccagagactatttcaaaatacagcactatcctgaaacccactatctgcctgctctggtttcctgaagcaatgtctttcaacctaacgcaaccccactgatgtaactgcttatttctctgaagttcagctcaaccctcgtctcttccgtatgcctgttaactagagacttgatgcgcaagtaattgaatgcctatgtggattacgtttaacttatcccactctcaaatttgggagtttcatttttattcatagtagctatctcctataaaggaaattctgagtttctgtgtcagacaccgaaacccaaatttgccatttgtaacatctggaatcttggaaccaaaatcccagaaatattcaagaggcaaaaacgatgccttatttagagctctgcagaacataagagctaagttattggcaggagacgggcactttgctgatactttagtggggttaggacttacatggataacaattggattggagcaatgtttagatttccgaatctggttttccctaggacatataaaattagtgtgcacaacttgtaaacataataatttgtctcagggatggaacatctctccttgctattgaatcatgcttttactaaaattcatctggaaaaataaacgcttaataaatgacagtaattagaatgttcaaaagatgtcttctttgttcttttatactctttgatacccatgaagtaaaaattataaacagcttgttgtattataaatgctagtaaagattcatcctagaaaatcattttatttaatttcttattttttccaaatgtctaaattctcatgtctgtgaaatattagccagttcttcaaaaacaatattgatatttctatttgaaatcaaggcttaattttgctcatgattaatctcagaaataagtagcttatttctatgaccttactgagacctggtaacctaagaaggattatgtgtaactgtgtggaagaaatgaaaaggaggcggtaagtaattatttaagaaaaaataatattaatattgacagacacttcttgtgtctgtaactgatttcacactaggaaaatgaagcagagtttcaattttcttgttcataatttcacatttacagttccattgttttatcttgcttaactgttctagatgactgcctttacaaagcagggggaaaagaaggaagaaatgtttttgacagtaatgaaaaagacaagattagttctccttccttgcacatttttagaaaaagttggacattccctagcagattcattctagattattcgtatgtccttgtagcttatcaattagatatccattaaatttgaatatccctttaaaaaggtaaatttgtaagcaaaggcagttaattatttgtgaaaatgtatactgctggctttagcctgaatacaaagatagggtttatcttgctatcagtaaaattgggataacaatgaaaatatttttctgcttccaaagtcgtatacataaactgtagcttttattagaaatcagtgatgctgtttcacctacaaaaatttaaacaccactggacaaaatgagagctttgtgttgcctggagggtgaaaaaagtccatctttgccagcaacatcccttctactcttctgcttgtctttgtggcctccctccccctccctttcacaccaagccacctcaccccaccagctgttagggactcctcccctctttacgcagatcaccagttatcttacactgtctggctttagtctcagatgaagacattctaataagcaccaagttgttcagctcagtgctaactctgccaggaatgtgtgcatttcctaagagctgccgaaaatggaaattaaatagtttgaaagaattaaatgataatggtggcatttcatacaccagaagggcagattggcatcagtgtaagcaccttttcagtccttctttgagaacaccaggaaagtggctacctgttttgctcatgcgaaatttggatctctatacaaaagcaaaaagacagtttgtgaagcgttacaatattgcaagttgattcagggagaatgtgttgtgtttatttttgaactctctgctcctccaaggttgctgctgttcagggcagttctcactcacccactttctttgagctcatgtctgataagaaagaggtgaaactgtaaaaaccttttctattactcgtctccaaagctgatatgaaacctgtagcattcttaagaacccctggtgtcctggatgctgttgtgaaaacaagcataatgtttaatgtcttgagcttttattgaaattatatgaatattcaagactcccttggtgtacaagagacagattgagctttagaggtctcaaaatttgcagatatggtgatgttcactgagctcaactcttggtcaattttgtccagttcagagagggttaaattcactcttgggcacttgaagcctctctaatcttatcctgaagaagtggcgctctcccttggtttacagttgaggtcacccgcggggcagtgtttggatacagactgatgaaattatgctgcattgttaacattgaataccactcagtggtgaggaccgatgacggcactagggtcctttgactccttgggtacaatttcttgaaatagatgctttcccaaaatgtcctggactcataaaatatatgaaggattctatttggctttcatcatttatttaatttgaaagaaagttgttttaacagatttatcagagttaagaaatgtttctagggaatagaaaatggacaagataattgatctttgttgtcagagtcatgcattgtaattcactctctaaggtgacgcagcatctccttgagggcaaagctgccaaaagttctgaaagtgatctgcctgtttttttttctcacactgacttttagagaggcgctggtattttcaagacgagtaaatcctgtttacatcctgtggaaggttggctaagaattatatccatctctttttaagagaagttgaaataaggaaaattatagttggcagttagctgtgtgaaatttagtaatctttgtcagatgacccagtcataggcatgtattttttaaaattttttaacgaagccctgtgggtttacattttttaaagttcacactgatataaaggtttacccacttcaatcacaccttttgttgtgtgtgcatgcgtgtgtgtgtgttgtgcttttcaggagtggcatgtgactatgctgtttaatcagggctatatttaaaaacaaattttcgagggagtgtttctcacgttaattatgagataaggcctgagtgaagcaaactctgtcgcaaaggccaagtgtcatgcagcaggaagtcctggccatcccttccagccctgcctcagccagcctgccatctctctgtcagcgcataccactgcacaaaggaaatgccctcactcagctacaagtgcctcctgctccgtgcggggcctcagggccccagagccccgcaccagctctgacttctcgtggttcctggggatcttggcatcgtccttaaaaatggcttttgtttgggatcctctgggagccacggtgccaggaccatctacaagagccaaatcaagattgcgtttctcaaagtcctacaggtattactcttttccttttgtagctaggaagaattgtttaactgccttaggccccttgcaaataagcctttgccctatgttgaccttctaactcctaatgcttgttaaattgacaatatattaaataagagccaagaagatgatgtaaaccttgaaataggggtatgtaggtacgtgcagaagttgaaggaagttgactaactttaaaagctaattctgagagttaaatggcaaacttaacaaagcattcatattactgccacctgaaaaacagtgtattaacttgtctaatggcttaatacagtcaactctaaatgttagggaagggttcttgtttgaccaacaaaaaaaacactacattattcttcataagtgtttcagggcacatgcacatgaaaaaatggaaactaatgctgtttcaggtagtaattcagtgttcatcttgcccagcagaattacatgtcatgaattcaaactaaatattttaataatcttttgtttctggaagtcatattaaaaatcttgacctcatgacttcactaaactgtcaatgactgttttacaacaaaatcagcttattttaaccaaataactggaaagaaagaaaacacttaaaaaatattggatttccttcttcatttgagtattctaggtgttaataaagagaagattgattattctttattattgtttagaaagaaaaccttttctgtttttgattgattacaatctatagcactgaaaggtatctatttaatcaatagtaaatagaagtgacattgtttgcaaaattttggatataaggtctttcttatttagaccaaatgcagcacatctggaagctgccaagcctatgtagaaatatatattaacactgaattaaaatgtgttctgatttgcctgcatataaaacattcaaagtttgaattaaaataatttataaggattaattatttgctttagacactaaagaagataatgtccttggaatttttagggaactataaaatcagagaaatcaaatttaaaaattttgtataacaatgcataagcaaactttggcaagaggtaaatataatttgccagctaaaggtataggtattaactccatttatttttatttcaaaataaaataatgatttatttgttatgtttgttacagctataaaatttagttgaaaattttaaattatatgcttcctatgtgctttgcattttgttaaatgtgattctcatgcttattgtatgctaaattgtacatttagaacttaacatcaatgatttgctaacattactgtgcatatttccaacatatggtggcttctaggctctcttcatcactagatctgataacaagctccttaatatcataaatctccagctgctgaataaagtaaaagcaatagcttgattgactaatgaatttgagaaatctcacgaaatgcagagtttaagctcttctgtgtagtttgcaaatatattataaaccttgccttctcaatttggcaaagatatttttattttgaggtgttatggtattgtaacaatttaaagctatatgataaatatattttttcaaggttcctttggtcaagttctgaccctttccaaaatataagcattagcagctaagaatgactttttcatgtatttgaatacctcacatctgtaattttaacaagtttcatttgtaacaagtttaagaggtgagaatgacatctcaaatatccatcatgagtcagtttccttcggaagcttgagaggctcagtccttcctttacttcctcttaatttgaatatacaatttcccacagaataattaatttttttatatgtgctgctttcactgtttggaggttctagtttatctttccagttgcactgcaaactctttgaggttagaagtttccttacatacagcaaaaatgccagtaatgcctatttgataaagtattctgttaccctttcttatttggcatcacccgataatgttttattggcatagccaacttgatatgatcatatctatcataagttgaattgagtggaagggttagggaggtaggaaggcagttggccactggctcttgcatttctgcaggtccctcatgtatccaaaggagattacgcattcagccacgacaatgtactgacaataatgaaaaaaggtacatatcatataacttaaaatttttatcataccataatacctcaaatgcaccatgagtcactctatatatatacagacacatatacacaccacacacaggcacatgcacgcacagttaaatgctataattatcttctgaagagcatagttttattgcatagcattcttggaattaaaggtgttaaactatttgatgtaaacatgtaaaatatctcataatgtcacagccttgtttttgcatttcttattttttaaaaaatatacaaaatccttacgcggtgaaagtaacttaagcttatcttgacctttaagaggctttggatctgattccattattgaagcaactgaaagaactggacattggacaacatttcttcattgaatttctcccttataattttttttatgagcaatattttttatcttgtaaaatcttcaaatgtgcctattgtagtgtcatttttctttggctattgaatggataataatgcatgctactgggggtacacttagctttaactggaatatttttccttggcatggcttttgctgcctggtaatattcaggctaaaggaaagccaggtgtacaagatatgaaattcaattagtgtctgatttgttaaagtaatagcaaatcatatacatttaatgagtgttgactcttgagaaatacaatctgaaacagttttacaatgctcaaaatagatgtgaaagtttttcagctgtgacaattttttatcttatgtgggtaaaatacatttttataagaaaagattaatatatagcttattaagtttgattgaggcagaaagaaggattgaaagagaaaagaagagggagagggaaggaaaggcaggggagaggaggggagcagggccgtggaaggaggagtgaggaagagaaaaagagagaaagcagagggttacataataaggaaggtactttttctctgtgagcccagaagagattgccaaccatgttttcagtaatgggatcagtgttagcattagggcaccacttacaaagatgagtactaattttgagggcaaggtgctgatttatctgcctaggttctggcacacatgtttaaagattcacctaattactttagagcaacgcccctcccaagtattatagagaagaaagaggagaatgatgtgctcaagaaaacaatgtggagaagtttatattggttgtttaaacatagtacctaaaaaaaaaaaaatggggaaaaacgatctgggaagtaaagaaagaatcaaggagcaaagatttagcaagcctgtggaccctgacaactccaataagagaacactagggaattttgtgatttaaaatatattattgcttaaaactacagtagtgttcaaggaaactttaaatagaaaattactcttcttgagatgattctgtcttccaaagagaacaaatcacaaggatgttaaaaggaacattttatgtgacaagtttggggtaggtactatgtaaatagaagagaaagtcactcaaggtacatttgaatgtagggcagagattattccatagcattccacaggccagaaacagaaagtgtcttctagttttcttgccctttatagtaataggggtcatgggatagaaattctcagaaaatctccaaatctcatttttgccaattgtttcaacatcttttccttcccagcattttagcagagctgccaaacaggtgattaattaaatacatatgtgcatgcttgtacctcgtgtagaaggtctaatgagtaaatttatttgatatgacatagactgaacagtagaaggaaggattaatgacagtcagatcaacaaacaaaagtacaaatggtatctgggctatgaaaagataaagcaatatttgcccaaacaagaagatctagatatccctaaattacctcctatattattaggaagtaaagaccaaatctacaactttgatctggaaattgtatagtagctgatatgaacagggatcataggagagtgtggtctcatagctactctttgctactaccaaaacctgagtggtagcacatcagtgattgcccaaccaaactgcacaattcccattagaaaaagctgtctcaaacccacatcttagaaaggaagtgaatgccaccagtgaatcaatacactgggatgtaactttctgcataccccaagaatacctcctgttgcatagcactttttagttttcaaagcttttcagatgtaacagatgtgacagctgttgtttttagtgtgccacagctcatctcacttaattctttagggtaagtgaaaaagatgagtgtaattagtatcaaataagagaagaagaattgaaggttcagggactagagaccacacatatatgtggttagaaagtccaaagtaagaacagtagagctagtttgtattggacacttactatgcaccaggaaccattcccaatcccatacatgcattagctcatgcatgtcatcctccaaaacagcctcgggaggtggatctagcattacctttatcttacaaatgaggaaaccaggcagagcaagtttaagaaacctgcacaggtgtgaattctggaagtctgtgttagaaccaggactcctggtccctctcccacctccagcttcctcaccagatcctattatcagcacacaaggaaaaaaattccataatgagaggtattgttctaacagatgtactatcttcctctacttaactctgaatttttctctgaagacagaacaccacgtaatttgttatagaatagggcttagtaatcagttaaaatataaacttgttaaataatatctaaactgtcctctaacctaattgatgttggtttaaagaaatgctaagcaaaagcatcaaaatagaggtatttttatattaaaaagaagaaaaaggaaaatgaatccgttattttatattgtctgcttctgccccctcctggcttttgcttcatgggcttccatctggctcatttcatctggccaaaaacattggtcatgtggttgtattttactgccaaatattactccttggccagctgttcagaggagccagaagattctctgagctcgagaggtcaactccatcctgtgtcatgtctatttattctactggcatagtcttgactattaaactaggtttcttaatgatatttcaaattgtgagtaatgttggctaaattgacaaaaagaaattatagacaacatttatatctaagaataacaatactactaacaaccattgcacattgtaggaagaggtagcatggtataggaggagaactttggctctagagccaaacagacccagcttcagtgccaactctgctgctttcttgattgggcaggtttcctaacctctctgagccatttccatgtacataaatagaaaattaaaatatctacttcataaggtcgttgtgcagattagatgaaagcatgtacgtgaatgcaggactacctgccaactctttcatagcattttccaagtcttcactaacatttcacaaattttgtgaagcttcttttgtgaaatacattttcagataaactatcatcattggtaccactcttggtcacagaatagtacaatagagctggcttataaatggttaccttataagcaacttgcacatacaacccaggctcaccttggaaatgtagtgtgcaggaatgattgacagctggctagctctacagccacactgctgctgaggttcacattttcacattatcacttatagctatgagactttgggcaagttacttcatgtgcctcagtttcctcatttgtaaaatggagtattatgaggattaagtgtgttagccatgtaaagtgcctggcacatagacaacactaaaataaatgtcagctattattaataatagaatgtaagctccacatggcagcaatttttgtccttttttccacctttgtatggccagtgcctggaagagtgtgtggtacatattaggtgcttggcgtttgtgtattgaatgaatgaacctattagcaaatgtgttccgattcatggcaagtgtgaggatactctgcttccttttgccacattcatgggaagagggggttagagctgaaggaacctgatggttcatttgttcaaactcatttgtcttacattgaagagcttgaagaccttgaaaggccccagggtcatgcaacttgatagcggcctggtcagagctagaaccctggctctgtgtgcttctgtgaaaatctttgttccaatgtcccacccctcacttcaatacatatgccatctaattcagtgctttcagtaaggcagcaaaatgaatgaatgattcagagcacacttcttgcagacaggagagtgtataagagccataattgggcaatgaccatggaaggacaggtttctgaataagagaaagacttatccaagtaaaattatgttcagacattttacttacaagtctaaaaatcacttgctacaacagctacaatagggtttttgtaaggaagtaccactttgtaaacaacatttttgtagaatgcattatatgcatttttttcaaaattgaaggaaagccccatctcaaacattcaaaagaatctgctcaattatcaatgtagactagaaacagagatagagaggggagatacagtttgagtgttttctgtattatcatgacagcacatggaacaaccacaggcagaaagattacaaactctgcaataaatataaaggtattggttttataaggtggcctgcaggctacggaccagcacagagctctggcaaatgtggaatgccaggagatgtacaaaaaaatcaaggtgacaaaagaagaaaagacactccaaactgccaagggtttataatcatgctgtggatatttctgatcatcagtgtgttaatggttttcactatagttaaaactataccatttttgaatgggtaataggtatgaatatttatgcttaattagtagtttataaaatttatactatttattttcataatgttgattttatgattttcaacgagtgccatttgtccttaagtcatgaagtggatgagcccccatcaagtgattttaagagacagtaccttgactgagcagctggatcaaagcctgtctgatctgggcagagcaaataaggaatacttcttacaaaagaggaagcattcaattctatacactttaccttggtactccttgttctggaggcctcagcttctatcatgttctttgccacagtcatatacccaccttctaccttggctctccctcctcctaacttccattattttttctactttcaaactataattgacaagcctttttaatttcaacaagggtctgaagagaggtgtctgattttccgtaaggctgggttatataagcacacagagttgaatcagagcaaaggaaaaatccattggcaaaggaagaatactatatgctactttaaaacttgtctgaatgtattattttatttacttattttagaggcagggtctcactctgtcatctaggctggagtacagtggcatgatcatcactcattgcagcctcaaactcctaggctcaagggatcctccagccacagcctcctgggtagctaggactacaggtgcaccctaccattcctggcttaaaaaatatatattttagagtctgttttgcccgggtttgtctcaaatacttggcctcaagttatcctcccacctcagcctcctaaagtgctgggattacaggcatgagccatggcacatggctcaaattatataattcattagctggtaatagtgtaaatttggaagagaaaaactaaaatgataaagaggaaagatggattgtgaatagagtaaatatatattactgtaattatgttaagccaatcaaatgcaaaggacagttcaaaggggacaagtatgtaagccacattccaaaaaaaaaaaaaaagctttgaagtgaagctttaaaaagataagctttgtgttgagctaaagaaataaactctataaaaacaaaaccctaaaattgttatgacaatgaattaaacattcaaaaatgaacagaacagaatgtaaaagattattccttcaggtggtaaatgttcacaaccagctctctatgggggaggggaagggcactatttgtagtatttgctgatttctgtgccaaaaaattctctcacctgcccatttcaaacagcagaggtcactaaatgtggagttggcaagagatacatagacatagtactctatacagtgtttctatcatatagatacagtagatataagttgccccaaaaacataataatacaaaatgtagccaaatcattcagaagttatgagttttgaatacttatttccattgtttttaatataatttgtttaattatagttaaaaatttttatgtaatttaatttttaataactgttgggtattaacaactgacttataaatactcctaaaaatgtaacagaatgtagtgagggacaaaatggatgcggtctctgctttcatcaagtttacattctggtagagaaagacagaaaataaacaagttaacaataaataaaataaatagagactgagatgagaggttctgcttggggaagccagggaaacctttacaaagaaattgataatttatttgcatataagttcaagcatatccattccatacatctgtgagtacatttgtagttctaggcctgaaactcagaactgcacaaggtcaatggaaccatataaatattgacctcattactgacttgttttcagtctccagtctcttgagtgaatttacctttgcttctttgttattataaaaatacagtgagggaaagtaaaacaaggaggaagatgaaaagaagatgtagggggaagaggagcagtttacaatatactttctattacattgtttcacactatctcaaaactttttatacgtagaaaatactaaagcaaagaaaaatggaagttaaaaatcggtagcagtagtaatagtcctatagtaggaaccttgttttgtttgaaatatgtgtctgtgtctgcctacaaaacataaacaccttaagctaagaataactgtgagattaattttttattttcaaagaaataatacaaattttaaatcttgcattaaaaggaaagctagctggacgaaacttttctgacacacagattttgagaatagcacccataaatatgcttccaatgcttgtcacttgatccctttttggcaattaacttgcctttaattgatttgtggattacccactggaagttgctatggataaaggaatgtaatggcagagtttgtttatatagggtaacaaaatagactggctgggaggagggatttaactgcaaaatatccttgattttcaggaatttttcttttcacataatggcagtgtttagataaagaatggaaagttaatgaatcagatttgtgttcccatccaaagggaagatttatgtcctgtttaagaatcacattaatttgatgacgttagtacattctctagtgaaagagtggccactttagtggaggaaaaaaacaagcaacaaaactccttctgccatcttcaggttgtacctgacgaaaagcttttatttgtgggttctatgaagtatcactgccctgatctcagatgaactaaaagatgaaaacatttcatcgctcaaataattgtttatctcacatcttactggttctagaaaaggactatatattttccctcctaactttcctcagtttcttggtataaagttcaaaatgctttgagtagagttgttcaggaggtcctcagtggcactgccactcactggttgggacgtttttgttctctgtcctcctgtgtggaagatgacaaggacggctttgtgcaacttctgttgtatgcgctgcttttcaaccccttggatgagatactcatacaaggaacgtcaggtttttttcctaaagcaaatccgtgtaaactgagacaacataaaccttagggagatctgacacaccaaaatgccaagaaagggaaagaagaaattattatcggtgggggaaacaaattatcctgtattttggagtgaatttaaaaggcttattgtttgttttagcactacatgacttaaaaaaaaaagtctcgcagtcttgccttcctcatgttggttaaaatggaaaggattctctttctttgctatttatagataacccttagcactctgcaaggatctatttggtataaaatgatgggtgtgaatgtgccagtaagagagaaaaaaatgcttagccatatttactcatataaccaacatctaggtcaaaatcaaaatattaccagctcccaaggggacccctttattcttctttccagtcactatgcacccgaagataaccactaactgacttccaatagcatagatttgactacttttgaattttatatgaatgaaattatacaatataaactcttattttatttcagtcaatattgtgtttatgggattcattcatagtgttttgtgcattctttattctcattttgttagtattgcaccaaatgaatatgctacaatttacttattctagtgttgatggatagttaagtattccagttttaggccattatgaattagagccattatgaacattattggatatatcacttagtaaacaaatgtacatgtagtgttgcagtgttttgtgcatacacgtaggttgggtatatcccaagaggtaggatttctgggtcataggttatgcctttgtctttagatattgccaaatgtgtttctatactggttgccacatttatgtcgcccccaaagtgatgtttcagttctctgcattcttaccaaagtataggtcatccattttcagtgatggcatcttaaaaaatgtttgcctgtaataacaatgtcatcatgccttttatttatgcagttgagtcttttaatctttaggacctgtttttccaggaatagtgtgggtaacagtgagccattcacactctgtctgtttctcctcatgatgaatactatgtaactgtgaattaagtgactaaaataagaaacgatctgatatgcagaaatagagttttccctgtttgatccatatgcagcttaaatatgtgatgttattctacattttatccagattcatttttcaaaccaatagtaatcattgttagcaaaaaccaataaataatcttttattctgttttaaaatttccatgtcgtactttgagttcttgctatatatcccgtgctcactttaaatcaggttttccttcccgtacattatttcttggaaaatatgttttggacttttcctaaaccaccttaacctgttgaaaaacactagtaaatgcataggcagtgtaagtcacgctaaaataaatgtgtattgctttttcaagattttgtttacccatgcatttaaagaaggtttttttccctttattttctttcttttttgtcattatagtcattatgtctttttaatgttaagattccggtaatatatattcctcatttttatgtcatctccaaagctccccataactgattgatgatatcaatccggcttctggcatataaagtttgttgacctggttcagtttgtaccatgtcaaaatgtgatcattaattattagatgatgtcaggaaaaatttagtatgtgtgataactgtgggtcccatttcttaaagctttcaaaatccaatcttaaggctctctactttgtggcatatgagggaacataagtaaacattagagcaatatcaaacgtattctaagggtttcatgatgtgaaacaatatatcactttattaccagacagatacttcacatcgtgaaatttgaaaaagcatacgaggtggggcacagtggtttaccctataatcctagtgctttgggagggtgaggtgggaggatcgcctgagtccaagagtttgacaccagcctgtgctacagagtgagaccccatttctacaaaaaatttaaaaattagtagggtgtgatggtgcctgcctgtagtctcagctactctgggggctgagggaggattgcttgagcctgggaggtcaaggctgcagtgaatgtgatcacaggagtgtactccagcctgggcaacagagtgagacctcatctctgaaaaaaagaaaaagtatgtaatttttacgtaagagtcactcgattcatatcatgaagcttgtgctaaaaatggaatcattcagtgatcatgggctgcttttcaagcatttttcgctcaccctttaccattatgacagtaaactttggggaaaggggaaggcatgggccaatacatcttttagtatttcttggttatactaagaactactgaggaactgctaaggaacaactacatagataaaaagtatttttattataacccttgtgaaaaacctcttcccccataaaacgtttagtatcttgtatgaaggcataatgtacttttaaatattcaaatccaattccagatttcatttatgtgctatgtactgtgtaatccaccacgcaaaatgtaatttcttgcttttaatataaattttcattattatcataaatgaagtctcagaccacaacattttgttaggttgcattcaaatggtaatcataatatgacctataccagtttttgcatggaagggcagcagccggctgaactagatttccacttttgtcttggctcattaaacaacaatggacaagttaccttaacttcatgggtcctcaaccttctcattcgaaattgagtgtatggactgtatattacaatatccttttaagcttacagaaataacattatggaggtatgagaaaattgtaaatgatccaagatatgtgcctaaatatttcttcatacatcaagcatgcattcatgaaatcaacaccaagcccaggaaatatcaaagaatagctcaatgtccctgtgaacttatatccaattcaataattcatccaacaaatgtatattgagtatataatctgctagacttatgaagccttaaactttatgctgtacattctgatatatgttgttttaaccaggggttggtcagctttcaaaagtgacccttttgctaacattgttcttctggctgaaagctagtaagtataagcaaaaggagagatgtatatgatctcacttctatgtggaatctaaaaaagtcaaactcacagaggcagataatagaagggggttaccagggggtgatgggaacaggagggattggggaaatggtggtcagaggatataaaatttcagttagacaagaggaataagttcaagagatctactgtacaacatggtgactatcattaagaacaatgtattgtaaaccaaatattatatgtggtcacttataagtgtgacctaaataatgagaccacatggatacataggggggaacaacagacacaggagcataccagagaggggagggtgggagaagggagagaatcaggaaaaataactaatggatactaggcttaatacccccatgacacgaatttaccattgtaacaaacctgcacatatatccctgaactttaaataataacaaaaccaaaaaaaaaaaagaaaatttctaagagagtagattttaaatgttctcaccacaaaaaagtatgtgagttaatgcatatgttaattagcttgatttagctcttccgtaatgtgtacgtatttcagaacatcatcttgcgcactataaatgtatgcaatgtttgtcagttaaatatttttaaatgaattttttgaaaagaggaggggtgtgaaaatgaagactacttctgactttatattttatattctggggttacaagaatgagacctccctgatgcctacacacaaatggattaatgtgaaactgaaggtttacttgcccagtttacttgcccatgtttacttgcccagttgattcagctggtttatgtataattgtcaacaatttaaactctgtcccattcctccccaaaatttatgtactttaaaaatagatctcatcatttcaacatttcaatttatatatgagagaaataaaaaggactagtaaaaattatatgaagaagcaactccaaatatggtaatttatggttcaaaggagataggtaattgtcttctctcaagagccactagaccacaaaatatcaacatcaaagatgaatgcaagcgctaggggaaacgatacagatcagaggcaccatgtgttgtgcattctggtatttgtcagagataaggaatgaagctgaattttttcatggatttgtcttgaaggaaaataaaatgagaggttatgctaagtataaaactatctttacaaagttcctttccgttaagaccttcaaagatatgtaaaatcataatttgagaattgcttttaaggacctaattcaggttagctaacaaatcattatctaaaaagagagtgttagaatactatgcatttaaagtgagtagttcacttcatgattgagcagaaattcctgagttcaaatcatggctcttccacttgcagcttgtatgacatttatgaaattccttaagtgtgctctgtttcaggtgcctctgcgcctacatcattagagttattcaagtattaaatgagataatacatatatagccgttaaactagcgcctggcatagagtaaacagtcagctcacatcagctagcgttattcacaagaataggctatacatttctttccatcaaagataagtgcaagtttgaatagaaaaattaatttatgaaacaagactgattttatgcttttctatagtgcccatgattcaaaggaaaagaaggaaataatcaccaaccaagtgaccctgtaaaatagataggagttacgccatgcatacatacatgcatatatatgtattttggatatatatggatatattatgtgtgtgtttgcatacgcattatatatacatacatacctttgccaagaaaattggatgtctcatatctaaaaaactttcagtgttaagaactagccaagtgtcaagtacacaatttgtattcaacatatatttacagaatttaactttgtaaaaatttcaaatcactgttattgcttttcctacttgtaaaacaattacaaaaatcccttggcttttgtggtgtggactattataagggactctgatgcttcatgacagggagtaatttgatccaaagtacaacggagctctcgtgtggatttaagttaccaaactattgaagggacccatgcaccaccaagtattcaaatcacaatataatttcattattctctaccctcccttgcaaatgtaataactctgaactgataaacacattgtacctgtgtagaaaaatgccacccagaaggaagctgactgctaatctaggcctgtgctgtccaacaagagagctagtagccatagagcacttgagctgtggctaatccaaatcagatgtgctggtaatgtaacatgcacaaaggatttcaaataatagtgtgaaaaaaagtaaaaattttctcatttgtaattttcataatgattacatgtttaaatactaatactgtgtatagggttaaataaaacatatttaaattaatttcacctggttgtatctaagtgtccatcagccaattaacggataaagaaaatatggtacatacacacaatggagtactattcagccacaaaaaggaatgagatcctgtcatctgcaacaatatggatggaactggaggtcattatattaagtgaaataagccacacacagaaagacaaactttgtatgttctcatttgtgggaggtaaaaatgaagacaattgatctcatggagatagagtggaaagatggttatcagaacctaggaagggtagtgagtggcaggggtgtgggagtggagatggttaatgggtacaaaaatatatttagatagaatgattaagatctagtatttgatagcacaaaagactgattgcagtcacaataatttattgtacattttttaattaaagagtataattggattgtttgtaacacaaaggataaattattgaggtgatggatacctcatttaccctgatgtgattattaggcattgtatgccttatatcaaaatatctcatgtaccccataaatatacctactatgtacccacaaaagtaaaaagtaaatacattaatttcacctggttgtaaaaataactttttgtaatatggctttttaaaaatttaaaattacatgttgtggccatcattcatggttcacattatgtttctactgaacagcgttgatctagacagtagacactacgcaaaaacagctaagaaaattattaattctttaaaaggataaaatttaaagtgataaatgagatcaaattttatgagcaagtccatcgtagttcactctgtgcttgtttctagggaaaaaaaattggaactttctgtagagtgtgccagtcaatgcaaaagtgctcatcaagagagaattaaaacattagcaaataggggctgttgatgaaaatgagattccagagagggtgagaagactgaacacattcctgtaaagcaacagggattaatgcaccaatgagaattgcttttttttttttaaacaaaacaaaacaaaacaacaaaaaaacccactaaatttttctaggggaaaagtaaatgctagagtgatattagtgaattaggggatttgtgaagatgcatttgaatgtcaagaatataatgtagttttcttagtatttttgaattcagtgaccttttgttaacctcaagagactgaggctaagacaccaacatttaccatgtgcttcaatcattctctcaaggacgcacagctcctctgagctgtaataggaattcaggtctgtgtgactcctgagcccacatgaccgaacgtgtgcccatggaacactggtccctgcaactgctctgcaaataatggttctatacttaaatcattttaagaaatgttgcatgtatcgttaccgtcttaaacatgattcattgatttgcatattaaaggcactgagaattgctaaaaaactgtttaactttttaaaatctttttctcaaacttcttttgccacagaacacctcctcccctgcacatgcatctatatgccatttatcaccagttgcatgctgaaactaaccttagacagaatgctatttggaaatgctgagatgccttaaattgccttctatcatctctcattattagttactaaggaaaatggctttgagaaaatataaaatatttcaggaaaatatgtaatttgatgctcagataactcactttttgctacatcagaaaaagcaaaactagaatttaaaaataaacttggatgcatgtcttggttattcttatattcatagtgtgtgatccaaagggagtcaaagaaatctgtagcgaggctgctcacagtctaggtctctttttgtgtaggacaaaggtagggcttggcttctagttgaagctacagttctgtaggacttgggatttggaaaagtaatgacaagataaataagttatcaccatcagagacctaaatggttgcaaatttggcactggttacataatgaacaaaagtttcataacatatttcataagatattttcataacatatgtcttacaattactttttttattttctgaggttttttctctaaattatgctaaaaatgtcatcgagaagcataaaaacagactttcattaatagttgctatagcagtgggaaatttttgtaggaatttaagtaaaaaagcaagttatttagcagttttgttcaaattagacatttctgccatcagcctgccccctgggaacttggaaagtgcatacttgctcttgagttctgctagtgccctaaccacacgcctttcatgtctaccatacttcgatgatcttggattcaaatatgatcctctgccttcctcacagaaagaaacaatttagggacatggacttaatggtaatgactttcaaaagctaatgacgtgcagtctttcggcactgcctagccgaacactctttagacaacctgctgctttagactggacatgcacatgattcctaagatacactaaacaagaatatgagatgctgagtccattgtttcctgtgcaaaattcagttcaccaagaatactattttcaccaagaaagccatagactgtgtgtaggtaaagaacttttgcgctaatgaaacttgttattggctgggactaggggcctaaatactagtttgagattctgtttctgctgtgccatatagcatgagatcccacttttgcctctataaagcagggctatggttatctttccttattacctcagttgattgttggctgtgagaaccaagtaagatatgcttcatggaataacagaagaatgcaagatattatcacgggaggcaacatttttgggatatcacatattagtggaaacttaaagaatatttgagaggttatctttgacatttacataaaaccatgtatgaaacaagtagttcttgtgtttttttaacctatgaactttttcaagtgttttctccacaacattcctctcttctaccaaagaaaatcagtttacagtcatgtgttttgtaaaagcctaaatgggaatgaaggtggttagtaagagggttcacaagatggagaggctcccatgacatttgtaggtttaatctcgtgccccatgacctcttaaaatgtccccatgcccattcagaataccccaattcacttcaaaggcaaaaacaacgtgacattgtgaaatcataccagatgttctagtagaactgtgttctggtcctattgagttcacccaggagaggcatcaaactctgcaatcagaacatatcaacacatggcctattagctgattctgccacttggtagctgtatattctctctctgtttagtgtccttatctgtaaattgaaataataataatagctcataaggctttgtggggattaagtgagataatcatgtacagtgcccagcacagtgtctactgcatggtaaatactgcaaaaatgttagctgttgactgctcctatttatgaccttcattattaaaaaggggaacttaggctgacgcaggagaatggcgtgaaccccgggggacggagcctgcagtgagccgagatcacaccactgccctccagcctgggcgacagcgagactccgtgtcaaaaaaaaaaaaaaggtgggggggggggaacttatgaatgcctttcacttataccagcatcattaaaaatttaagttttttaagaaccatgaaaagctaaccattgacaatttaagaagcatgcaagcttggtttacaaaagaactggacaagctcagaatgggctagttcagtggagtgactgctgcaggagctcaggttttgagaccttcctgtcttcttccttcatccttctcctctttttgtgttctctccacacacttttcctcatcaaagccaaaacctttgttcttgctatattctctttttagagcctgctcacagtaaaattttaaaaaaatgaagaagtgctgaaagtgtagataagcaattagacatgagttaatgttttttatttgcaagagcatttgcattctaatatgaactgaacattgagtaaatagattcctgactccctaacagggctatgtcttgtgtcaggaagccagcgcactgggcttcttggtaggcaggagacccaagtcatcatctgctactaaggctgggtcttggaagatggagaaggccgtagaagaaaggaaagccaaaaaaagaaaggaatgagattttgatatattaattagctcatactataagcctggacttttgctaggcattttccatggtaatttggttatacctcaaaacaattctcaacattattatcactgccaccacttctgttagcagctgtgagaacagaggtcatgtgagtaagcagtttgctaagggttgcatagcttaaaaagtagtcaataagctaaagtttgaaccctgagatgcctggccttcacagctaaacttttattaattacacctgcttctaacaacaacaaccatggctaaagtttcattaacctaccagtttctaacaacattaacaaaaacattttcaaaaatataataatagtcatcaataggaataaagggaaacaatccaaaaatagctctgttgaggttactgatggatggggacaggaaagtacaaaattttttctacgaaagtttccctttgaggatcactttccttggctgtcttgccttgtgaaattataccttccctaatggcttggagctgattgtgcccttctttctgtcaaggacagcttaaacttcatggaatagtttatttgaagcttgtgggtaccaattccaggcagcaagatactactttcagagattcaattaacttccttcagagtcacagcaaaaagcgatagagctaaattgattaccttgaagtgccttaaccgttttgctgctgttgttacttcttgagccaatttattctcccagcaatgtcactgttactgaagttggtctgttctttattctcagtttatgaataggaatcatctgaatatagttatagacctctagtctagatcattttttgcaaaattacaaagatgggaaaatttccaagccatagttattccaaatggctgggagtgccttaggaacttatttctggagtcttttgaactatttatattattgatatgaacaatgcccctgattgttagttagcaatctattcattgatagggacatgaaaggcagtctgctgccatctagctttttagtttctatctttaggaattttccggtcctttcacagaaagacactttttaaaggagcaattcttacttcatccctgagagggagacacttatgaaggtactgcagaatcttaaaaaaaaagtcttcatcattcttttacttctttttgcctttaagttggtcttaaatgggtaaaagtgataaatgtaggttgtgtagttcaaatccattgcagtgactaagcagtgaccacccataggggcaaaaactatgtatttttagaggcaaagattgataaccacagccatgaccctgagcaagactgtgaaatagatgcagttctttgccatcctcccttttcctgagttatgggcactttctgccttcatagctgtttcctctgcaaaatggagattttactgtcagaagtctcctattgctattgcttcttggagttggttcccatgctctgggcacaggaaagcaatctgagatcttcactactagtatttattgagcacctatactatgccaggactggactgtgctctgaggtcacagtggtaaacataccgacatggttcctgctgtcatgagccttccaaaggaatagcgaagaaaaacattaaacatatcagcccatgattaaatgcataattagataaaatgcattgaagaagtaaagatcccaggaaaggagagaaccaattaatatgatggatgggaaatcaaggctgctggaaggaagtagtgtataagctgaaaaatgaggagtgaataggaattagccaagtgaaaagcagaggcaaatgggtttcaggaaaaggaaaaacatatgtaccagtaacatttcaagaagaaatgggaaggattagatgatttctgttattcttattaggttgatctcttccatggaagagacacacagaatgtaattaatttatagaatataaaaatgatttttttttttaggaatggggaggtgaggagaagacccgcttcaagttctgttccaatattaatatggttttgctttctctacaaacctaagtaaaacaatggtggtaccaagggttggttgggaggcactagttttcccagtgtacatactcacaactaacataaaagctaaatacgtataatcaacatgcttacactacaaacacaacttcaaataaaattcactagatcaaccgggcacagtgcctcacacctgtaatcctagcactttgggaggctgaggcgggcagatcacctgaggtcaggagtttgagaccagcctgaccaaggtggtgaaaccccatctctataaaaatacaaaaattagccaggcataatggcaggttcctgtagtcccagctactagggaggctgaggcaggaaaattgcttgaactcaggaggcagaggttgcagtgagccaagatcatgccattgcactccagcctgggtgacagagctaggctccatctccaaaaaaaaaaaaaaaaaaaaaaaaaaaactccactggatcctctcttccaacttttttcccctaatttcttcccttagcactgatattatcaaacaagtggccaatcctataaaggctatcagactccaatttaaaaaaactattaaatttaaaaacactcagagatataatgattgtatgccttttatgaggaaacttagtacctaaaagaaaaccctataacttaacattaagcatatgaaggtagctattattcaaataagtagcagtaaagacttttcagctttggatcctcataaacaagacctgcaggtttaaagatttgcatacatcttttaacaatgcatcatttttattatagtatattatatactattttatatttacttaatgagattactgacctgggtttcaagatatgtatgaaatataattaggatatgaaaattaaagataaattatccccaccagaaataatcttagcaggttatttactaaagaatcttaaatccagcagatcaagaaaaactccccaaggagtctttaattagaactctttaggatggaatcaaaatctctccataaaaaatgaatcttgccttaggctacataaattacaaaatctgaagccctttaagcagcattaaaactgctgattttaattgctctgataatgaactggagagagacacactaagcttcctggatttctgttggaaatgaatgggattcttgccaactatggatcacagttatgaggtattctgcacagggaaaatcaaaagaaagcagatggaccttgacatgctatgccatcctatgccttcttccttcccaagaagcatgttacaataactttaagtgaaggttgtcacaactttaagtgaaaagtctcccctttctgtctaatttttaatgtaacttcccccttctcgatatatccagaaaatagttaataacaatccctgagggaaaagaaaaatgctgcccttcatattaaaaaaaagaagataacagagatccccttagtggtgagtgatttatagtgaaaacagccaactcattctcttttgcctccttttgacctagagaactggattcgcggatttgtaactggattttgattatagagtatgttctatggctacaaaagagttttcctttgaggaaaactcaaactgccaacagatatgcttggtatatcagttttcaatgctttcaattgtaaataacagaaacctggactcacaatagcttgaacaaataggaattacttttaagtaggtggcaccggaggtgtttcagctgttgcatgatgttatcaccatttgcaaagaggcagcatctccacaattttcttggcctgttcctcttgatggcaaatggctactgcacgtccagatgatcatgtctgtgtcacagatagtgagagggaaggaggaaggatgagagaggatggccagctaaagttgtatctaccccacttataagaaacacaaagcccttccccagagcttacagccctttagccagaactatgacacatggtcatcttgagtgcagaaagatggaagttaacatttggttttctggtctttttaataaagatagcaaggatgaagaagtttggaaaagactgtgggctagccaatcaaattgtcgaccacatttggcctgtattaatgtatagtttttaaagcctaatgtcaatttgttaaggtgtcttaaggacaggaaaatggagaagaactaagattttttatatcaaatacagagtaaatcttggaaagggtgaattagagtggaaaataaactagacattatctaagagtgccttgaagccagatcttgcaaaacattaggcaagcatgtcactcataatggaccccagggctttccatctcataatgtggataaaaataacagtgtttctctcagtttttaaaaatgtcaccaaaaattcaataaagtatatacatacatattgtaattgtttaaagtaaaaattttatgctgttttgggaagaaaaataaccaaaaaaaaccatcactgaccattggtcatcaaaatctgatttatgccatgtttacaagataaaaacaagaataaataataattgtttgaaatattttcatcatattgcctctgaaatgattgatgtcatactgcctggatttagtcaactcagtgaatgatttatcagtagccatgctctaaggagctctctattcatagatacttatgatttggtgaactgggaaacccacagagaaaggtaaatgaaataggagagccaggtaaatgggccatggatctaagaaccaggaatcatgattgtttggaagaacatatctcagactgagaaaagctggcgctaaagtaagctagcatttgattagaatgttgaaggataatttcattcttggagacagaaaacctaagtagaagcaaaagaagtaggaaatagaagcctgtgtttgagagattcagagtgactgtgttttattagaattgcaagaaagggaacttgaaaacataaatttaacatggggcaacaggccttggattctgaacagagggactttgtttaaggatggctctgtggctgtggaacagtttttctatagattatcaaaatgattctggaaaagaaatgtcattctggactgagagcacataccatagggaaaacatgaggcttatgggctgaattgtgtcacacccaaagtcatatgctgaagtcctaacctaggacctcagaatgtggctttatttgaagattgagcctgtaaataggtgattttgataaaatgagatcattagggtagacccgaatccaacaaggctggtgtctttataagaaaaggagattaagatgcacgcgcacacgcagagaagactacgtggagatgaggagaagatggccatctacaagccaagaggagaggtctcccgaagaaaccaaccccactgacatcttgacctcagtcctctggcctccggaactgttttaaaacataagtttctattgttaaagccacctaagtctgtggtattttgtaatggcagccctagggaaaaactacaatgagcaagtattatttgtattttaagaaataatattataaactaaattcatggaggggaaaatagaaaaagaggtcatttctgaaaacattgtataggtgtaacatagttgacactatcaactactacaatgggatcaggagacagagggtcagtgataacggagctctcaagactggaaactgggcgatccagaaggacaggcggttgatgaaagaaaatgatgagtgtggttgaggctgcgtttcccttgaggaggtgctggtgctcagggtagaggcatccatcacgatgtcagaaatgtgtgtcagacacgaaggcaggaatgaggctgtcgaggaagccatggcaacataaacagagaagtgccacagcgagacaaccagccaatgagttgtgtagtttcttgtaagtagctgaaacaacataaccaaattgttcaatttagtctacatatgaaatttcaatgtcagagaaaggcctttaatctcaaaacgaaataaactaaaagacattattttcctgacagctaagtcttaaaatttcttttgagaaataaaaaaaatggttttctcttttaacatagaggcaaaccagtaagtcagatacttcaggggaaggtagcttggtgatttgaatgtatgtgagtgtgaatacgtgagattagaatcttacctgagaacaaattttcatgagcatcattggagagtgggagagcatgaagacttttacccttctctctgcaggagagaattgtgcaggaggaggtggggagaatgccaccaagaacaggttgcctggggctagtttagcgatggggtccaaacgatctcactaatgtgaaaggatcatagttaccttaccaagggaaagttggcttcaactatatatttcacttctgtaccaggttttgcttaaatgctactctttggagaatatcaagaaatttagatgagtttaccaaatccaagattgtgttccctgcttttaactcttgttactgaaatagccccctgatccccaagagtaatgcttgactgaggtgtttgcatgaattgtttatatcattcattaattaacgtgatgaacatattaaagataggactcccagttttcatcccaagggcttacatataatagtaacaacctttagaaaagtactgcattgtttatttatagaatggctttgactcacttaataatgctccataattaatttgtaaattactttttgactttgcacaattataatttaatgtcatatatctgcaaaagaaaacacttttatgttgctaatattaatttcccttcataaatttgagactgttttgactatagataaatgtaaaatgtcaatgtggtgagaatgactcagcttctcagatattcatttattctataaatatttttgaatacctactatgtttcaggcactgatctaagtgttgaataagtagacaaggacagcctgccttcaggttttttacattcaaataacacaagatgatgaagaaatttttaaaataatctggttccatttggcagataatatagatatgctcagttttataaattttgatacctaaagtattgtgataatccaaatcatgacctttagacattacactatgcttattgattgaaggttgacatatgtttagcatattctcttataatgtatttaaggacttcagtgagtagacaaaagaagtaaacttgatcagacaacatgatttctgagaacagactcttcctggagcaagcattctggttagattttacagggcttcaataaaaaggtatatgtttatgctttttgctagttgggggtttcctagcaaatgattccatgaaaacatttgcagggaattcccatctgttctatatttccctgatttgggggctctgaatcaataatgctgatgtaacagttggcaaattagataagaacagcccgagacttccttttccattaggtgtagtctcatggaaaatcacccttgaatccatcaatggaatgaagcaactgggtggagcctatgggaaaatcctggaggaagtccccaactagtcagcctcccctctctgccttgcactcttggattccttagcgaaacatccaaaatggccttcttgcaaggaggatgcagtcggtgatccacatactgaccaacagctgtgtgtgaaaggcaccgtgcccaccacaacaaaggggcagtgaggtctgctgagcagatgagtcgcttttctggacccttccaggcttgcagttggctcagatgaaaagctcaggcttatgagctgccagaaagtatttggcaaaaagcccaccttttttctcaagtacacgtattcaattgacttgattcctcagagagatttgtgagggtgaaagcaagttcattgtccacttttaatgaccctcaacttctaatgaggtaatatatgtgaaagtgatttttttaaatgcaatgcaaatacagggtgtttttagtcattatttcagtacctgaggaaaatgtaaaaacacaaagccacacatgtaccaaggcactacatgagtgtacttggtttcaccatctaatttagccctctgaagtgtagagtccatcgaggctattattttgtggattgtgtactgaagttgcttttctttgttctcccaacatacacttgtgacacttccaacctctgatatgtatatgttaaatacaggctgtttttcaaacaagataaatcaaatgctagctaggaagtgtgcctagagtttaaagcattctagaatgtactcccatataacagctatacttatataatacctacattgtgccagtgtttcatatatgtgaagtgctttaatcctcacaacaaacataggagggatgtagtattattaccccctttttacagatgtgaaaactgcagtacacaaggtgaagtgagaggccccaaatcacacagctagtaaatggcagtgtcagacctcaaattccactagtctgtcttcagagtctatataattaaccactgctccctgtgcttttaaaggttagtttaatggatattgtgctatttctaataaaaggatataatttttgttatatatttttcttcttagtcttcacttttggatcttggaccacatgtgctattatcatattttagctcataagagacttctctgataattttgtataaaatacacttatagaacatttgtatcttgtaaatgtaatttttcttaccattatctcatttgatcccccttatccacctctagaatatacagagctttatcctcatttttcagacgaagaaatggaccaaagaagactaaacaatttgttcaactccatatcaccagtttgtagcagttctgtgactagaaaccaaatttcctggctcttagtcctacattctttctagtatttcaaatcatcttttcatttctctcccttatgcttttggaaagaaaattgagaagaacgttaagaaccccagtaaaattggagaggcatttcttgagaaatatttaaaataatttaagaagtcttcacaaaagtagtaggcaaaaatgtgttacattaacaacggatctcattaagtcagtgcatacagctaggttctggtttattaattttcaattttttcatttttgggcctgcctaatctgaacactttgcagtacaattctgagtgctctcatgctttgtgctatcgctttcttaaggtagctcatttgcacttgttcatcatcctgttccttcccccagtctcctgggctctgttgctaattattgacccaggaaagcctcagaaggggccaaggcagctaaaattggagtgctctttacttagacttataatgcattttccatttttcagaaagagtaaagcacttttagctaccagatccagagaccattcagttatatgggcacttgagtttctgctaaagaatcacaactcaatttaattttttttttttttggtatttcattcacagccagtctggagtgtgtgtgtgtgtgtgtgtgtgtgtgtgtgtgtgtgtatttctgtttctgtattaacatatgagacagcagaataataatgtgtccattcattccatagatatttctcaaagagttgccaagaataaagaatagtgctaaaaaaaggtggaagatggttaggtgtaaaattacctcctctcacaggacctggcacatgacaaatgcttcagaaatatttatcaaactgaaatgagctattacatgaattgtattctctggctttggaatctattggggaaatgatgaagtcattaaatatatgcgaattggaaaggaatttaggaatcatcttatgcagcccttttactttaaagatgaagcaatggaaatgcaagaaagttatgtgtcttttccaagcaagatcacacatctatttcgaaataatatgctttttttcattgtaacatgtgttttagagattacacatatgtcaatgtctgtagtgcagggcataatgtgaggagagctgttgaatgctttagaacagtgctacccagtggaaatataatgcacaccccatatacaattttagatttttattaatagccagatttttaaaagtttaaaagtcagtgaaattatttttttcatactaagtcttcaaaatccagagtgtgtattatatttttgacacatctcaatttggactagccatattttaagtatttaatagttatatgtgtcttggggggggctactctatagactatatggctccagaatcacagagagggaaaaataataatgtatttttaaagctgcagtatttttaccatgggttatatttttaagtttgattgtaacacaaaagtacaaaaatgaaacaaactgactcaacacattttttttcttttttttattattatactttaagttttagggtacatgtgcacaacgtgcaggtttgttacatatgtatacatgtgccatattggtgtgctgcacccattaactcgtcatctagcattaggtatatctcctaatgctatcccttccccctcctcccaccccacaacagtccccggtgtgtgatgttccccttcctgtgtccatgtgttctcattgttcaattcccacctatgagtgagaacatgcggtgtttggttttctgtccttgcgatagtttgctgagaatgatagtttccagcttcatccatgtccctacaaaggacatgaactcatcattttttatggctgcatagcattccatggtgtatatgtgccacattttcttaatctagtttatcattgtgactcaacacatttaaaaaaaaaatctagagtagacctatacaatttgacagattgcatcaatagttacaattttagacacccctacccctccacacatagaaattagtgaataagcagactgtcaatagtactggctcaaataattctacatacaagttctaccaaactttcaagggaggggtaacttctaccttatacgaattatctcattttacaagtaactataagtatacaataagttccatttgcagcactataggagcttgaactgtctgccaatttttaaagaatatgctcaagcaataatcttggttatccatattatcttacatttccttatgaatattgagagttctgttattgataaatacaaaggtgtcactgtttaatacactactgtgtaggtccttttgctatgcatttactatttaaagcgtaaaaacgtaggtagcaagaagatttatctttctggctattcttgaaattcctgtttctaacaagatattctgcagaagcaaagatactactgcattgttcaatgtttccacaaaaggttaatataattgtgggttcagctatcaccttgaccttttcttggatctttgatcagagtttaggtaaatatgttgttaggtttcccccttttaagttcctgagcttttgaagtaaaaccagagctgagataggaaagtgaacagcaaggggcagagcacagcagaaactgaattaggtcacttttctagaggcttctgaatttggtacagtaggatttctgtgatcatcttaaacctagcttttcaaaaggctattactgttccattttattctctggcccagaaaataaatcagaagacttctacatccttttcctcaaaagctgattctgattctctatatgatgccacattaataaagttttccctattaattaccatgatgccatgcagccttctaagatgttttctttagttcttagttcctttgcagttccatctccaagcataaattctcattaataatcagtacagtgaggaagatagacatgtgtcagtcagtgagaatgcttgcagctgtaactgccagaaagttgtaacttaactggcttaaaccaaagccatcctgaggtgggaggctccaagtcactcagtgacattatcaaaggcggcctgagtctttttcatctttctcttctgccagcctcaagtgttggtgagttttctggtttgttcctgtaaactcgagatgtctgtcacaggtccacctattacatgcagataactatggccagtcagaaaagaggatcttctttttacgtcttcttttaagaaagaaaaaaaatcatttccagatggtctccccttgtcccacttcccttcaatgtcttattggccaaaatggtttcacatgccgatgtcttaacaaatcactgccttggaaatcgtactttcatgattagctgagacaatcaggtttccctcatggtggctggggctgaggcccacctccctgtaagtatgtggctgcaagggtaggtggatatttgaatttcactgggggcctagtaggaaggaatggctcttgggtaggctacccatagagtcaactacaagtaaatcagaaactatagtatcataagtgctacagggaaacatgtaaatgcaggatgctgtaggaacacgcaagaagggcccctggccatgcttgcttgagcaagagggagagaggaatgccagagtgggcttttaatgaaaatgttatctgatctgagatataaagctcaagaggagatagccaaggaaagggtggtggaaggagagagagggtatcaggtagacacagtatcatgtgcaaatgactgggaataagataaaatgtggtaggtttggggagatgcagaaaaattagttggcctaaggtatagagcataagttggggagtcagtcagaaatagggctatagaggtaaactgtagatcataaaagatctgataagtcacatagaaatttctactttattctgctgcagtggggagccagtgaaatattttaagcagcaaatgacataattaaatatgcacttcaaaaaaaaaatgtctttggctgctgtgggaaattggattgcaaatcttcaagaccaaaagtaggtagaacatgtgagaatcaattacaatattccaggaaagagtggtgaagggctttaagataatgtcagtggggctggagagaggtgaataggtttgattgatgtttaggggttttgactaaacaggacttggttaataggtaagagaaatagggattaataatcactcacatttctggcttggacaactaggaggatgggaatgacatttactgagttaggatatccaaagaagaagcagactgggggcaaggggagtgaattaatttaaattgtaactaatgaagggcttattctgtatgaaattcaagagaagtattccagtccttaaagcattttcaaatgccaagggatatattaaccaataagtggtatagaacaatactaggggtactataatttatcacagatggtcatcaataaagcaagagagagagataaaagagcttaaagaagaaattgcctctctctcagaaagaattagtgggagaatctgatgttcttcatgaaagaaaaaaattttagttgaatcttgcataaaaagattagacagatgggaattgtcgagggtggaggcactgtacactacatgaagcatatttaaggaatgataacagtctagattgctagcaagcttgaataggcaaaataaaatagaaaggttagggattagttgaattagtcagaactgttgagattccaagagaaaaacaaaattcacattttctgtgttgatctattattgcaaggtgcattagtcagctattgctacagtaatgctaccgaacaatcaactacaaaataccaatgacatttgcttcttgctcatagtcctactaatgggtcagaatagtgctgcttcaggctgcaggttgccttcatgcttgttcttcatgtttctccttcttggaccagtgatctcccagggcgtgtccttgtggcacagtttacaactcccaatgtggcaagtagaaatgttcaatactttgtaaggcctcagtttataaagcagtatcatttgtgcccacattctgttagccacagcacataatgtgactaaacccaatatcactgagggaggagagcatgaggaagaaaaggatggtgaatatatgctgcaatgcctaaaacataatgtaaatatagatagcattggatttgacccataagccataaagattctagaataccagtgttcccaactatggagtgcccaatgagcttcttgacaaactcaggagagtaacctccatttgtgtgacctcctttctttgctctttatttgtgcttttcaaagggatgacatgagcccataaactactcattgggttgcttggtcagaatcagaaccagttacttcaggactgtctcatttcatgattagttgcctttggtctcatgcagtggtatcagttcattcctctagaggtttatgttccctcaatcaccagcaatactgagtgaatgataagaactaaagcaataaaaaatgattgaactattttccttagtatgtagttattggacttcttccaaaaatccagcacacttataaaaaccaaactaaggcattttgctggttattgtgccaatagtgtgtcttaattagtcctgagaatttatgtggcccatgaaagaggcataattttcctaagattgcacagctaagttacatatctgagacttgaagacatcctcagattatgttatccctaaatctctaattgctatgtagcaaaagattttagccatttttttattcctgaatcaaggatacataaataaagttgtattcaatcaatccaaaaatcctcaagcccaaataatcctagtacttgagcagaccttatagtgtgtgtgcacaagtgcgcatgcgtgtactctatttttagattatcttttaagagggaccggtgacatggtcatacagtacaacagaagaactcactccctgtttctctataattcccatattacactcagcacttgctctcctttcattctgtggcttctgtgctgctagcagtgaccagtgactcaggaaggctgcatatagtgaagaaaaagttgcctttccaggcacagttcagtcctgaggcgccttttcacaccatctcatagacatttcagagccaaactctagctttctttttatgactacttttccattccacacttttcttaatgttgcaggagataatttgaaagaaaggaaaaaagaacagggagaacacaaaggcaagaagatgagcaagatgccagatttaagaagtatatttatatttagttctttacaaattaaattctgctgagacccttaaatattagctgtcacaggggttgtgcttgaaaaacttgattccaaccctaagcataaaaatcttgtctaggcagggcagtagattggaggattatcattacacattataggaggaaggccctgttcaatgccaggttccaagaatgccatctcagggagcgagggaaagacataggccaggtaacatgtctgatgtatggagaaaagccctcagggtgccatgttggtggaacaggagcagaaaggaaatcagactgagagaatgaaaactcaatagaagcacaataaacagactgaacaaagtacagatggagtcagttcaagtttaatatgaatgtccctgggccctgtgtttcatcccagtgttaagtgcaggaaatcattggatttctccaaggatgggtctttagagcaaccgactttagaaattgaatactttaaaattattttctataaacaaatttatcaatagaaaaaatagattacttaattggtttatcttaatgagaaaacaacaaaaagcttcaacaaataattgttgctgattggttggtgggttcgttggtgaataatgagaaggaaagaaggaagaaaagaaaagaaggagtagaggaggaaaggaggtgagagagggagatttgaaagggaaatagcggtgctctaagttcacaatttttaaaagcctagagttattaacaaattatgccctcaatcagattttatataacttttttcaatcttgtcatatattaatgtgctgtattcatgaaatgattttgagattttaaagcaatgattgacaatatagtagttcatttaaagtttttacaagttgctgctgacaaaatatgggtaatgaattacatcaaataagtataaatataagtacacgctttgaagttaaaactcagtaagttgttatgattaaaattgttcactttattttcctcctgtgtatgggtttctcataaatggtaacttatacctatgaaaatacagggttctataaagtctgaaaacatagttattatatatcttaacggaccgaagatgtccttcctgatattatgtatagcctgtgtttccagactaagtgccaggcactattctaagttaggcacgattctaagtgttttactgttcatttaggctgtctggctagtgtttttctcaccttatcagcatcccatttttattaagtgaatttgcctaaacacacctgcacacgcacatgcatgcgcgtgcacacacacacactttttgcatttggaagcctggctattatggaactctagaacatgagagctcagggtcaaccaccaagactcaataaggtatggctggggatgtgaccaagactatcctagcatctatggctgtggactgggtgtcttctccactgacccttgaaggtagttttgcttcactgctttagaaatggtgcagagacttaatcttatttcacttttcggtgtttgtcttggttcctgtagaactggcttgaggcttagaagatgtcctcccacctgcatttggaaaaatacatttctaacacttctcctcatatggaaatttttaagtcattgaaaaactcatactgcagcatttgtagaaacaatttcagaacagagtaccttattgcttttcctaaaagaattttaactgtgcatgtataagtattataaatgcataaaatatatagttaatccaaaagacataactatatcatgcatagtagttataggtcacctcagatatattagtaacatctttttatagagactctgttgttatttcactcacacaaaagaataaacacagaattaaggttgaaatttacataagaccagtctaaagccagccatagctatgtaatttccatgattttctcccaatcaatggaaaattactgtcagctgagccaaagtctgcagactgtgagcaaatgtctgtttccttcccacaactgagtgtttgaaacttttttcaatcagtaaaattaccattaaaggtcagagattagtttttcatgcatgatggattccatttgctttaaaagtattataccaggagagtagactttttttctgactttagaatcaaattagaattcaaatattcagagttttgggtcaacctcaaactattttattttgtttattttcccttgacaaaatgttattgttttaaatagggaaggagaaaggtcttgggaaaacacacacacacacacacacacacacacacacacatatatatgtactctctcatatttgaaattagcatgtagtttaaggatactgcacacagctctatgatgagcttaacttgaatctccttagattatgagcattttgaaagcagggacttgattttttaactaaatacctttcatgtttgataacctgttccttttcctgtgtgtattgtcttaactaaagactgcctgcaatgaacagaagggctatggtcttttttttattaagataaaagaattttccaaatcgttgtttataaaataaaagattagaaaaattcacctgtgtataaattgaactagacttctataacatagcagccatcttgtgcagaaaggggctgcttacgtagtttatttctttaacacacagttgctaattacaaaaacagcatgcatccagagattgtgaaaaaagaagttaaaaaaaatcttgcctattattctaccaccgtaacacaattatgtttaacatttttcatatttttaatttattttctctttccataaattctaatctgtctataaatgtactattgtggtctgcttcgttgactaacagaatattttcacccctttcagaaccctttttttaaaaaatggcttcttttgtgtatttgaaacaatttcaacttaaccctattgcatatattctgtaagtagctgtccttcatgaaacagacaactttttcttttaaaaatcaaggagattgtacagaactttgtgattttaattactgcatggcaaactaattcagtctcatatcctttccatttaatagggatttgtccctagctatgtgacctaagcaagctctttaactgtactccacctcaatttgcttatctgtaaaacatggataatattatttttagtctaaaacttcctctggtatgacagaaaagaccaatgtgaaacaattccctgaatttgtcaataaaccatgttacatttataaaaatgcctccagtgtacccagaccagaggaatctgtggcttatactaaaacgtgtattatgtattcattctcaaggtatatgccaacagttaagttagaaatccatccctttctctgtcacttgtccaaagtcaattactccatgcttcttttacataaggaaaactatcttaaaaggaggaagtaagatcacggacaaacaaaagttcataaggtctttcattttactgcctttcaaaaggttaagatcagagaacttagacatgcataagctttggtttgaggaacaattgagtcaaccatcgtaacagagggcctgaaagtatctgaaggtagaatgaatagtttatagtaagccagtccactctcagctctgagaacatccagctgcataacctcaagggaactgcgtggaaaaaattaagggaaattctttgggctttagagcttttcatttcctatgaacaaggcatctcctgcccttgtctcacccatatctccattgtcctcatgtagtcttctgctggttcactgtgtgcctggcaagtcaggttcttacgcgagggaaagagctgttttaagttgtttatgaatagagaaagcagattcagtcagacgtaatctgactctgtatgcctgcaggggttgtggcctttgttagtttattatgcctgtaatttgggaagtcatgctgcagagatgtaaagtgggatgggcctgaaataggtcttgtaataaaaaggcagttagggaagcctgctggtgtcctgcctggttactactatctaagtgcagcaatgtgttagttgattttaataaagagttgaaatcattgttaactggcctccctcccactgagtgaagaaggcagattacacaggcacacgtttgcctcccctagtgtgtactatgaatgcagctgcttctgaagggccagcacgtggccttcttaaaactttccttggctggggttttcccttcttgccaactggtgcccaccaagccagtggatgctctcaacgtctaggcaaatgccaaaaatgtcatctttggctcagatgtgcactggcctgttagagacaactgccatgcagagaaggaatgtcatcagctgctaggtctcaaattatcagcctggattgacagctgcaggatgtagtgcctgcctatagtactgaggccatgacccacctctggagagaccacagcctcatccctagagtagaactggaaattctccattgagacaggaaggcagcacttgaacctggcaggttttggagtgaagtgtctaaggacagaatttctcatttctccacctctgcccatgtgtaaggcagcaatattttcatagaggtgaagaaggcaggtgtcccgtggttattatgacatctgtttacctcattctagtcactgtgccatgtttcacagccattgtcaactacatttggtgaaaactgtttcctccgtccacaactggaacattgacactaaccacattctagagttcattacatagagctgtgtctgtgggtaagttaacaggtagttttaaataactagatatagtcttttcctcttccatgtaagccaagataatatttccacttctccttctgaacatgtgagtacagtttatatataaatcaacagcaagatggaaatttactctgagctttgtgatgttttcactttaagatgctgtagttctgatcctttatacatttatttcattttccccatctcaaccccagtatatagcaacactcacctgctctagaacatgattatcaactgtttcagctatcaatgtaacattaaaaaaaaagttctatgttcaaagactaaaggaacccaggtagtttcttttaaacagaaagactagttttcatgatcataaacatgtaaagaaatatgtcatttttgaaatttcatgaatcttatgtctataccgattccaattccaaactcagactggcaatctgcctttattattgcaaagccccatagcttgttatcttcatgtacctcttgatcaagtatttaagtgaaataaagagtctaaatgttacgggaggtgagtccaggcagggtctacggccctcagtttttgtcttcctggaagaaaaaaattcagctgagagacagatgtagatttcagacagaagcaaaagtttattgaagcaaagtacatttggaagggaccaagtgggcaactggaaagattgagtgtcccgcctgattattggctcaggactcttataaagttactatttcctgattcttcctgatctcctcccatcatacttccttttgggccagctgttggctaatcgccgcgtgctcagtgacttgccagtaatctgggaggggctgcatgcgccatttggtggttgtagttatgcacatgtactctttgggcaattttcctttactggtctagtgcccccagaggaaggtcatataccagtcaaactttgccattttgccccttactgtgcatgcctgctcaattcctagggttttatcgcaaagttgttgcctacaagcttaagatgtttcctgttaggaaatttccccctccctggtgccagccatgaccatctatcattcctgaagaggccacctgacagtcacaatgacagtcatttgactgtctcctgacattccttggggccctatcctgccctgctcatatccacctatctacctaccctaacatattcccccctcaagagtgtgagactcaattatttggggctagtggatgaaggtcagtcctctgtggctgcttcctgctgaaataagggctgtatttgtcctctgggtctcaatctcttgctaattgtcagaacagaatggtcccatcggtaggtagaattggtgtccagccaggtccaggggaaacaggtgtatgttttcttcacatttgggtagggaggtagatattcctgtattgcagaatttctgctcctcagttcagctaaatccaggttctgtgtcacgaccaggaaaagttaggcatgcagacacgtggaagggtgaggggaatggaatttattatttattgggcgaaaaggaaaacaagaaaagaaaaactttcagcaaagtgagaggggtttctgccagcaggctcccatctcacagattggattccaagcccccacacacgagctaaagttcccaggctctttccccccaacaaggcatgaacttcctggtagctttaccccatcgtcgcagtgcacaggcgggcgggagattctccagggatcctccctcttatctgcctcctgcatctatcacctgcattattgggaacttggtttgaaattgttatatcctggagaagacaaatttatctagtaggttaaaaggcaggggccaaaaagaagtagacgtatggagacagctggttcgagcaggggaggaaccatgtgagcaatgggagagcagattttacagagttccagatggaatctgctgagggattttctttcccagagtcatgaagccacttagcgtggtcacagattctctttatatgttcctctacttgcccactattgttgacacaagtgcaatagggtttattgatgacagcacagacgactctgttctgcaaggaggtaatctagagctagtctgttgtccatgactgcattagctactgaattcagtgaagccttgagtttagagattctgttcccagttctctgacctaggtctccaatttgtgtagagaggttttggagggtgactttatgataactgaatcctctgtatggggcagctaatcctatggcagcccctagccctaccattataaggccaagagctctccttttttaagaatttgtaatgttatagatggttacacctgttccttgtggccccaggagtcctagggcacatcccctgtatgttgggtgttatctatgcagataaaaaggtttacaagtgagggggttgaataagttcttttagaacttccctcacagggcagtttattttgtttaggtccatataaaaatacatagcctggaggggtgtaggcccactcgggaatgttggttttgaaccaagtgtaagcataagcaatcccaccatgaataagatccagagtactggggctaccttatgctgagctagcattagtttgaaagaaaagaaggcattacttataatttcattgaaagagatattatagatcttccaatgactcacaggaatactcaggtgctggtcctattgttgattgttcagaagcctctcaaggttttatttaggaatgatgtatccaactagaggtgccaggaactttgatagctgttgcagtggaaaggaaaacagtaaaagggcctttccatgaggggattagttgagattttgtagatccatcactttaggttttaataaggacctgggtgggtacacaagttggttgttagagggtctggagccagcagtactctctgtatatatatttggttctaggtatgaaattctctgtcttggatttggatactttgtaccttacattttgctaggaaggttaaggtttgtactgcatattgttgtgcaagctttatggagggggagcagatgagtaagccatctacatacagcagaagttgtccccactcaagatatagcttggttagatttctttgctgggtcttgtccaaataagtgtggggcatctctaaaaccctgaggtaggactgctggctttcctgggagaaactgggatattagggggaaatatcagtccagatgttgggtaaatattaagtggatacccattttggaaagtatattcctactcaaaagcagtgtgaggcatttagacattgccagggactagtgggagaatagtaattagtcccataagcaatataaataaaggggatgtgaatctttagaggaaggggttgctacttgctcctgttacccaacagaatttgggggtaagttgcctagagaaaaaggttagcacaaagtaggcagttcttgtatttaaaaggatatttatagcactacctgtcatttccagagtttcccttggctctgttcctttaatgatgatgtctgatttggaagctggccagagtggagggccccttcagctcaaggccattattggatgggggttcaactgggggaccttttggatcccagggcagtccctcttccagtgggacttatctccagcttatcacaaagagggcaggctgtgtggggcttcctcccatttggcccatttggaaaattccttctccagtagcctggtcttctgcatcagtggcagttacctggaggagggtccttaggagaccctggagggggctggtgggcttgtaaagcagccaatagttgagcctgcatcttgtccctgcatttctccttttccttagccctgtcctccttgtccagatctcagttataaaagactgaggaggctaatttgaggatttgtggcataggggcactgggttctaaggctgacttttgtaaattttcctaatgtctggagcagcttgggtaaattgtcctttaggactagtccctcaggagattctgggtttaagtttggtgtgcttaataagtttcctgtagacttttcagaaaggctataggatttccatttggcccctggtttatggtggctaattattgtagtttagaggcttgatcttacttcattttattacctctattagacacaagagcctatggttcctggcccatattcccgctttggcattgtagtcctgattggggtccagctggggaacagctgtagcccctccagggtagttggcattttccaggtgtaagtcatttcgacagtggattgctgctccgcagatggtctgtctttcctcttgtaaaagggcttgtcccaggagtacatttatgtccttccaaattaatctaaatgtaagagccaatttggggaagccctctatgagccttttggggtcatctgagaacttttttaggtttttcctaagttgtcaaaagtcgtacatggaaaaggggatctggacctggacgagttcagttggctcacttacctcctacaagcttggagaggagaactaaggagcccggtgtaaagtggggccaattccaaaggtctgggagtgggataaatagggggaggatccaggggtggctgtttctccctctttcacctccaaaggaggaggtagtttttccttttggcttctggaggaagaaatgttggagaggaatcagcagaggagtctccagggccgatgcagggccctggaggagatggctaagcatagctaggatgtgaggtttgccttacaagctttacgaggattagggtcttccctttaggccataaaggtttgtaaataggggacctctggctttttgccctgataatggcagaaaaggtctagccggagaatggtattaaaatttgtacttccattctctagccagacttcctctgcaatgaaaaattagttttttcattttagggtttggtggttggatttatcgcagattttaaggatgcatccaaggggtcagtcccagagtatggagacaccgttatctatctgcaagacagaacagggaagagtaaggaagaggaaagagtcccttcttcttcatcttttttctttttctgtttttttttttttttttttttttttttgagacagagtctctctctgttgctcagctggagtgcagtggtgcaatctcagctcattgcaacctctacttcctgggttcaagtgatgcttgtgcctcagccttccgaggagctgggactacagatgcataccaccaagcccagctaatttttgtatttttagtagagacggggttttgtcctgaactcaggtgatccacccgccttggcctcataaagtgctggaattataagcatgagccaccacgcccagctgaaagcattccttcctgatccccttataccttggatcagagtagtgagtagggcatcccccattcatcctggagttctggaataaaccagtgattaccaggtaccactaaccctggtcccacatttccctccaggaccagccttcatctctctgctaatggtaatctgtcctgcacctgtggcctctggctgacctgtacctttgacactgtgatcttacagtgacctttgtttggagcattccagcaatgaaatggttttcctttctctcaaattcccattctccatatccctttaggtaggtgaggatcttatccctagccagcagctgtaagggaactgggccttcctttctctggacatagcactgtaggtcccagtatatgttaagaatgtagatggtcagaggaacagaggaaaacctgcatctgagtccccttgtcatccctcctgtggattcctggggaagcatggaaaacaagtatttaaaatgacaggacaatccatctgccacccgtgggaatggtagaaaataagggatattcatggaaggctgcttttgtacagtctcacaaacagcagcccttagacctaagaggacattgcctatcagtcttctcagtgtagaggaagaactgtcagggccagggagtttgggatgagagaccacaaaaggcagagaaagaattgtcctctccccaaagtgcagatagctctagaaaggaagtaggagttgctcttaatggaccacatacagatgccctatggagacaaacaaatgacctcaagagccactggaaaacctggtctcaatgtgtagcaggatttaaaaattcatgataggaaataaagaattggtggagacagagtcttcccaatattaagcagagaaagaagttgcatgatatgcagaatagaagcagggaagaggttgacttgcccccaagacagacagtgtggccagcatataaggccatctcaaagtccacagaaaaaaaggaagcataatagggtgtagacttattggggaaaagtccactttggttaaggaaatgaaggtctccagtctttgaatggcctaggctcaagccctatcacccttgtgagccacctgtccaaaagggccacagtgacttaggtctactcagtacagactctgaagtcctccacctctgctgtcgcccaccaggatgaactgaggaatctgctagagggaagagtgaccaaagagaatttttctggagatgggctggtgagtgagacagcaagagaaagaagacctcacgtaagcagagttgggtgcctccagccaaagatggcaaggcacagagggtcttaccgagaagctgcaatctgattcatgacaccaaaatgttactggcagcgggtttgggcaggatacacagtctttggttcttattgtctgagaagaaaaaatacatccaagagacagaagtagatttaagatggcagacaggaggcaggactagattgcagctctggacagagcagcatgtggaggctcgcattgtgaattatagctccagattgactgcaagaacaaaccagcaaccttgagaggacccacacaccctctgaaggaagcagactgctcttgcaggacctgggaaacaccccaaatactgtgagtaccccaactgtggaagtgggaaagggagaccctcctctcctgaacacacacccccactggagaagctgaaggtctgtttgcaagagaagtttctgactttacctggagctgagtcaatgtggagagctgagtgaaatacagaggcaaagaaagtagcagaaaggccctggaagctctctgagtcccctagcaggccatccatgcctggcatcacagggatccatccagagggcagccagagccagaggtgcaaggggtaaaactctacagggagaagaaaatctctagctgaagtttgtaacaatttgaatggggtgagaagcctcctggccagaactcaggggagggcacacatctggcgtgcagactccacaggtggagtagaaccaatccctttcattcacagctgggaggtgggtagcctggggcagattttcaagctcatcttgccctccaactgaaaatggactcaggctgttagagggtgggagacacagtgagagtgagactagccatttggtttgggtttgcgtggaagcagagtgaggcctgtgactgctggctttcccccacttccctgacaacctgcatgactcagcagaggaagccataatcctcctaggtgcacaactccagtgacctgggaatctcacccccatcccccatagcagccctagcaagactcacccaaggagagtctgagctcagacacacctagccttgcccccacctgatggtccttccctatctaccctgggagtggaagacaaagggcatataatcttgggagttctagggttcctccccatactaccacagctgatgctctctggaaggcaacacctcctggcaggagaccagccagcacaaaaatagagcattaaaccacgaaagctaagaacccccacagagcccattgcgccccccaacccctaccccctgcaccagaacaggcactggtaacctataaaggaaaatctgtgagattaacagcagatttctcagcagaaagcctacaagctagaagggactggggccctatcttcagcctcctcaaacaaaacaattatcagccaagaattttgtacccagtgaaattaagcatcatatatgaaggaaagatacagtctttttcagaaaaacaaatgctgagaaaatttgccattaccaagccaccactacaagaactgctagaaggagctctaaatcttgaaacaaatcctggaaacacaacaaaacagaacctcttttttttttaaattattattattatactttaagttttagggtacatgtgccatgccggtgtgctgcacccattaactcgtcatttagcattaggtatatctcctaatgctatccctcccccttccccccaccccacaacagtccccagagtgtgatgttccccttcctgtgtccatgtgttctcattgttcaattcccacctatgagtgagaacatgcggtgtttggttttttgttcttgcgatagtttactgagaatgatgatttccaatttcatccatgtccctacaaaggacatgaactcatcattttttatggctgcatagctttccatggtgtatatgtgccacattttcttaatccagtctatcattgttggacatttggattggttccaagtctttgctattgtgaatagtgccgcaataaacatacgtgtgcatgtgtctttatagcagcatgatttatagtcctttgggtatatacccggtaatgggatggctgggtcaaatggtatttctagttctagatccctgaggaatcgccacactgacttccacaatggttgaactagttgacagtcccaccaacagtgtaaaagtattcctatttctccacatcctctccagcacctgttgtttcctgacttttgaatgattgccattctaactgatgtgagatggtatctcattgtggttttgatttgcatttctctgatggccagtgatggtgagcattttttcatgtgttttttggctgcataaatgtcttcttttgagaagtgtctgttcatatccttcgcccactttctgatggggttgtttgtttttttcttgtgaatttgtttgagttcattgtagattctggatgttagccctttgtcagatgagtaggttgcgaaaattttctcccattttgtaggttgcctgttcactctgatggtagtttcttttgctgtgcagaagctctttagtttaattagatcccatttatcaattttggcttttgttgccattgcttttggtgttttagacgtgaagtccttgcccatgcctgtgtcctgaatggtaatgcctgggttttcttctagggtttttatggttttaggtctaacatgtaagtctttaatccatcttgaattaatttttgtataaggtgtaaggaagggatccagtttcagctttctaaatatggctagccagttttcccagaaccgtttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagcgtgatgcctccagctttgttcttttggcttaggtttgacttggtgatgcaggctcttttttggttccatatgaactttaaagtagttttttccaattctgtgaagaaagtcatgggtagcttgatggggatggcattgaatctttaaattaccttgggcaatacggccattttcacgatattgattcttcctacccatgagcatggaatgttcttccatttgtttgtatcctcttttatttcattgagcagtggtttgcagttctccttgaagaagtccttcatgttgcttgtaagttggattcataggtattttattctctttgaagcaattgtgaatgggagtttactgatgatttggctctctgtttgtctgttattggtgtataagaatgcttgtgatttttgcacagaacctctttaaagcgtaaatcacaaaggacctgtaaaacaaaaatacaagctaaaaagcgaaaacaaaacaaaacaaaagtatacaggcaacaaagagcatgatgaatgcaatggtacctcacatttcgatactgacattgaatgtaaatggcctaaatgctccacttaaaagatgcagaactgcagaatggataagaactcaccaaccaactatctgctgccttcaggagactcacctaacacataaggaccaacataaacttaaagtaaaggggtggaaaagactttccatgcaaatggacaccaaaagccagcagaggtagctattcttgtgtcacacaaaacaaactttaaagcaatagcagttaaaagagacaaagagggatattatataatggtaaaaggccttctccaacaggaatatgtcacaatgctaaacatatattcacttaacaatggagcccccaaatttataaaacaattactaacagacctaagaaatgagatagacagcaacacaacaatagtgggggacttcagtacttcactgacagcactagacaggtcatcaagacaaaaagtcaacaaagaaacaatggatttaaactgtaccttggaacaaatggacttaacagatatatacagaacaactgcaaaatatacattctattcaacagtgcatggaactttctccaagatagaccatatgataggccataaaatgagccttagtgaatttaagaaaattgaattatatcaagcactctgtcagaccacagtggaataaaactggaaatcaactccaaatggaatcttcaaaaccatgcaaatacatggaaattaaataacctgctcctgaatgagcattgtgtcaaaaatgaaatcaagatggaaattatacaattatttgaactgaacaacaataatgacacaacttatcaaaacctctgggatacagcaaaggtggtgctaagaggaaagttcatagccctaaatgcctacatcaaaaagactgaaagagcaaaaaagacaatctacagtcacacctcagggatctagaaacaagaacaaaccaaacccaaacccagcagaagaaaggaaataatcaagatcagagcagaactaaatgaaattgaaacaaaaaaaaaccatacaaaaaaataaataaataaatgaaacaaaacctggttctttgagaaaataaataaaattgatagaccattagcaagattaaccaagaaaagaagagagaaaatccaaataacttcactaagaaatgaaacaggagatattacaactgacaccactgaaatacaaaagatattcaaggctactatgaacacctttatgcacataaactagaaaacctagaagagatggataaattcctggaaaaatacaacactcctagcttaaatcaggaagaattagatacactgaacagatcaataacaagcagagagattgaaatggtacttaaaaaattatcaacaaaaagaagtccaagacccgacagattcacagcagcattctaccagacattcaaagaattggtaccaatccttttgacactattccacaagatagagaaagaaggaaccttccctaattcgttctatgaagccagcatcaccctagtaccaaaaccaggaaaggacataaccaaaaaagaaaactacagatcaatatccttgataaacatagatggtaaaatccttaacaaaatactagctgactgaatccaacaacatatcaaaaagataatccaccatgatcaagtgggtttcataccaggggtgcagagatggtttaatgtacacaagtcaataaatgtgatacaccacataaacagaattaaaaacaaaaattccatgatcatctcaatagatgcagaaaaagcattcaacaaaatccagcatccctttatgattaaagctctcagcaaaatcagcatacaagggacatacattaatgtaataaaaactatctatgacaaacccacagccaacgtaatactgaatggggaaaagttgaaagaattccctctgagaactggaacaagacaatgatgcccactctcaccactcttcttcaacatagtaatggaagtcctagcaagagcaatcagacaagagggagaaataaagggcatccaaatcggtaaagaggaagtcaaactgtcactgtttgctgatgatatgattatttaccttgaaaactctaagaactcctccagcaagctcctagaactgataaatgaattcaagaaagtttctggatacaagattaatgtacacaaatcagtagctcttctatataccaacagtgaccaaggggagaatcaaatcaagaactcaacccattttacaatagctgtaaaaaaaataaaataaaatacttaagaatatacctaacaaaggagtcgagagacttctacaaggaaaactacaaaacactgctgaaaggaatcatagacaatacaaacaaatgggaacacatcccgtgatcatggatgggtagaatcaatattgtgaaaatgcccatactgccaaaagcaacctacaaattcaacacaatccccatcaaaataacaccatcattcttcacagaattagaaaaaacaattctaaaactcagatggaaccaaaaaagagcctgcatagccaaagcaagaccaagcaaaaagtacaaatctggaggcatcacactacctgatttcaaattatactataaggccatagtcaccaaaatggcatggtactggtataaaaatagacatatagaccaatggaacagaatagagaacccggagataaacccaaatacttacagccaactgatcttcaacaaagcaaacaaaaacataaagtggggaaaaggataaccttttcaacaaatggtgctgagataattggctagccacacataggagaatgaaactagatcctatctctcaccgtatacaaaaatcaactcaagatggattaagggcttaaacctaagacgtgaaactatgaaattttagaagataactttggaaaaacccttctagacattggcttaggcaaggatttcatgaccaagaacccaaaagcaaatgcaataaaaacaaagataaatagctgggacctcattaaactttacgagcttttgcagggcaaaaggaacagtcagcagagtaaacagacaacccacagagtgggagaaaaatcttcacaatctatacctctgacaaagggtagtatccagaatctacaaggaccccaaacaaatcagtaagaaaaaaacaaacaatcccatcaaaaagtaggctaagggcatgagtaggcaattcacaaaagaagatatacaaatggcaagcaaacatatgaaaaaatgctcaacatcactaatgatcaaggaaatgcaaatcaaaaacacaaaatgtgataccaccgtacttctgcaagaatggccataataaaaaaattttaaaaaacagtagatgttggcatggaaggggtgatcaggaaacacttctacactgctggtgggaatgcaaactagtacagccattatgggaaacagtgtggggattccttaaagaactaaaagtagaactaccacttgatccagcagtcccactactaggtatctacccagaggaaaagaagtcattatttgaaaaagacacttgtacacgtatgtttatagcagcacaattcacaattgcaaaactgtggaactaacccaaatgtccatcagtcaataagtggataaagaaactgtggtgtacagatatatatacaatgaaatactacacagctatgaaaaggaatgaattaacagcatttgcagtgacctggatgagattggagactattattctaagtgaagtaactcaggaatagaaaagcaaacatcatatgttctcactgatatgtgggatctaagctatgaggacacaaagatataagaatgatacaatggactttggggacttggggggaagagtgggaggggggtgagggataaaagattacaaatatggtgcagtgtatactgcttgggtgatgggtgcaccaaaatctcacaaatcaccactaaagaacttacttatataactaaatataccacctgtaccctaataacttatggaaaaaaattttataaaaagtaatagatttaagtcagaagtttattgaagcaaagtaaagtacattcggaagggaccaagtggaaaatttaaaagattgagtgccccgcttgatcattggttcaaggcttttatagagttactgtatcctgattcttcctgatctcctcccctcatccttcttgggggaactgttggctaatccttgcatgcgcagtaacttgctaatatctgtcaggggctgcatgtgccgtttggtggctgaagttgtgtgtatgctctccatgacaatttttcgttactggtctagtgcccccaaaggaaggtcacatatcaggcaaactctgacgttttgccccttcttgagcatgcctggacatatccccgaaggaaggccaaactccgccattttgccccttactgcagatgcctggtcatgtttgcttagttcctgggatcttatgaggaagttgttgctcataagctcaagatgtttcctgtttgggaggaaattttccccttcttggtgccagccatgaccatctgtcattcccaaggaggcccctgacaattgcatgacagtcacctgactgttgcctgacattccttggggcactctcctaccctgctcatatctgcctatctgcctaagtaacatgaagacattttaaaccttctcagtggttctcccatttcttctctctctctctcccccactttcccttcaaaccacctcaaaactcctttctatttctactcagcaaaatggagattaaaacctcactaaaatgtgtctttgcccacccctgccttcccatttcacagcgcacttctttcttcaaacagatttagatttacagaggaaaaaaggcagaaattctctttaccggcttcagacacttaaagaaaatctgtccttttcatctctacacgttaaaatatttgctataataagtgtagattcaagagccatttggacatatctggcttttaaatagtgttgactaatgaccaacttaacttagatctttgaatctatgtgtggtgttatgatatatattagttttcatctgaggtctagctcataactcccacagcccttgttacagtcttttgttataatgttgggtgtgttaggcctcaggggcaggcccctgaccttctccttctctcctttcacctgttcctgcctttctgattgtggcttttaagaccttccccagagagagtactgccctataccctgggggaaggaatgctgatgtcatgaagcctccataaaatcccagaaggacagggttcagtgagcttccacatagctgaacacttggactttcatggaggttggcacagccaggtaaggcatggaagctccacaccccttcccccatacctcaccctatatgcatctcttaatcggtaacatttgcaatatcctttataataaactagcaaacataagtaagtgttcccctgggttctgtgagccactccagcaaattaattgaacccaaagagaggattatgagtatgccaacttggaggtggccggttagaagctccagaggcccacacttgtgactggtgtggtggggggcagtcttgggaactgaaccttcaaccggtgggatctgacattatctccaggtagacagcgttggaactgaattacaggacacccagctagtgttggctgcttggtgtgggggggaaacctcacatgtttgttcgtagaaggcttcatctgtgttgatgatttttgtggtgtgagagtagaggaaaaatgccatcagggagagttttctctacaccctatagctcctagatgctttttatttaagacattcaaaccttgtgaaaaacaaacaaacacaaaaatctttttatttaagacggtcaaaccttgttcaaaacagcacagacattaactcggaatttaggatttattattgattaattgacattatcttcagtctgttcatattattaagtgatataagtcaggtacacacacacatgtatggggagtgtgtgggagtgtctgcatgaagtatactgtcagaaaatatactcatttcaaagaaacactgatttaggccctggcaaataaggaaacatttctatttcttctagaaataacacattcatttgccaacatctgatctatccatatgacctcttaatacacacatgaaataataaagtgtatttttcattcatttaataagcatgtgattcacgtgacactgtaagccttttttttttttttttttttttttttgagacagaccctttttctgtcgcccaggctggagtgcagtggtgtgatctctgctcactgcaacctccacctcctgagttcaagcgattctcctgcctcagcctcccaagtagccgggactacaggcacgggacaccacgcctggctaatttttttgtattttttgtagagacagggtttcgccatgttggccagactggtctgaaactcctgacctcaggtgatctgcccacctcggcctcccaaagtgctgggattaaaggcgtgagccactgcgcctgggcgagcatttttttttattccagtgtttctcgttaatctaccccatggcgttttatttcaggttgtatgtatgccagagatgaaaaaaggcaaatgacagaagagcaagtatatggagaaagataggagggacttgagaaaacttggcaatttactaaaatgaaatggcattgtttccatatttaccaaaaacagacaaacaaacctaatcattcctctcattttgatcagctttcatgtatattttctaggcctaatcaaaatcttctttggtgtcacaaaataatggaagagacatgtattggtttaggctcctgcagcagtagaccccaatataaggaatattagttgtttatttaggaaattcaagaaacctaagtaaaggagtagggaagtgagacaggaaatggaaggatctctgaaaaaatacacatcatcaagtccgttcccacagagggaaacaggagctcagtccccattgttgggttctggaagacagtgtggaacagaccccagagttatcccaactgtgagatgaggaagctggggtgcttttcaccaactcttcatccatcacctgcttccgggggtcattaacaatccaccactcccaggttatttatgctcaggccaggcatgtaactgcagccagaaaatagcccttgccaagactcacaggaattaaaaaccttcaggcaaggagctactggtctttgtaataataagctttgagaggcgggtattcagaggctatgggcaccaataacttcccttatgtgagtcataaacacaaagttaattttgtttgcatgtgtatacaagtattttgaatgaatgcttctctttgttttgtgtgtttggaaaatttaaacaaaattattattgtttttgtattggtatttaaacatctgaatatgtaacatcaaagatgatattaaaaagtataaagcaaattatcacaaaatcagatgtgcagttacatgtttacttgaaattctctctagactacatttgaaataggagcttccatagggggaaatttaaattttttttacaagttgtttaattataatgtgctttaaaaacactttagcatatcataaaccttcaaaacaaaatgagtaatcatcttctgagatccatagaaaatgtttcttaaatgtcactttcaattaccacttctggagctaacttgcaaaacaattgtgtttccaccaactgaaatatgttttcaccaaatttaagataatctgtggtcagtgtgagctttgtcttgatttaggaggaggaaagcaaagttccatttatgaatactttgaaaattttcagaaattctcctaaattgtttcagcaaccaggccaaaagagaggcctggaatcccaaggtgagaggaaactttaaaagttacacttatggccaggcacggtggctcacaccgtaattccagcactttgggagactgaaatgggtggatcacttgaggccaggagttcaggaccagcctggtcaacatggtgaaaccccatctctactaaaaatacaaaaattagcctggtgtggtggtgcatacctgtaatcccagccacttggcaggctgagacatgagaatcacttgcacccaggagacagaggctgcagtgagtgagatcatcccactgcactccaacctagacaacagagtgacactctgtctcaaaaaaaaaaaaaaaaaaaaagtttcacttgtgccttggggttggctgcctgctatcatatttttgttgtgttcttctaccccaagctccagtacctcccctcacagaaatcacctctcctaccaaccccaagggaacccattccatttttattagagagttcttctttacatggcctcaagtcttttcatcaagatttactgatagaataacagtaaatccacattactccaggtgtctctttgcccttacctagcctttgtgtctatgccattcttctcaaggaaattgccttcctttatcagctttaaaagtccatatttgggatcccctctcctggaaacattctctgactatccagcccagataattttttttctctgctttctcattataacattcatgatctgtgtcattcattcattcattcatttgcccaatatttcttgagtgcttcctaagttcaggcactgttctaggtactggggacataggaggatagaagccagtcaaattttgcactcactgaaactttactttagtaggtaagaatctatagtttaaaaaaaaattcacatatgaggcctgtgaagcaaataaagcaataatgtggtggttttcatggacattatgtctttcactacccgtccctctttttgttgtaaactctctaaggcaagtataacctcatctatacattagtatttatttaccacaaggacccataagtatttattgatatatcttcctaagtatgtgataatattctaaatagatagtagatttaatcattgggatttatgtgaagttggattaaatagataacatgataattacatttagtattgcatggaaggacacattttctcacttatagaagcctaaacaaatgtcacaatgttgatagattcctttataggatgttaactctgaagctgtcgtgaaaatgtgtgaactagtttcactttcaacttgatccttttggaatcatgacagattttgctagcccttaattcttctgcaatctttgttgatccctcctatttcaatctcataagacacttatctctcctccagaaagatctgaagggttaagtcacctatttatacctaattacagtgagccctgtgttggatttttaagggataaaaggaagtatcagatctcagttaacttatgtactgtctacagtgcctaacaatgacacaggatgactcagttaaggagaaaaatactccatttatcagcacagaattcttccctttaagctatcatatggtagctaaccttgcctaaccttgcgagtttaaccttgctttttacgtgcatgcacgcgtgtgtgtgtgtgtgtgtgtgtgtgttactaatttctaactgtaccagctcctgaattaatatttggcaacatcaatattccttgtataatgaagaagcatggtccaagagacttggatgtgacctctctaaacatcaacttacagctgcaaaataaggaataagttgtaattattccttatttgtaacaactaccttacagtgttgttttgaagattagaagagaatatatagatgaagtacccagtggacagtaggtattgaataaatgttagtttccttccaccttctctggcttatgtaacaaaattactcattctactagtcactcagactttagttaatcattagctaaagagtaacaatgcaggattttttttttaataaattggctaggattggttttatgcctggatggaataggcacttgccatttcatcacaattcaaaattcctcctgaaggcctgaaggcctgaaatgtttaccattggaaactaatcccactgtatggttactattatttattatatctattaacttataaaatattaaaatataaagtaaatattaccctactgatgcattagccactcaacataaatgagtttcttggagattaataaagcagtacatcagtatgtcccaaacaatggctaaaaggaaacctagtaaccaccccgaccccaaacttgttttgttaggccagtcagatttttttttttcattttgaattagcatcacgattgaaagtggaaagatctcacatataacttcacatttctctgtacaattgagaaacgttggctatgttggctctctgaatagcagctacctcctttcaaggtttgtatttacaatatttcccacccccatgagtccttattatcctgacactgaggacaaatatgagttgctgtccatcagcattccaaagctgtttttttttttgttttttttttcttacacttagcctacttcactccctaacaccaccagcctgatttctgagggggcctgaggtaggaggaggagaatggagagcactttctctgagagccgccattttaacagatcattaaagacacgatattcacatgacggttgcttactctctgatgaaaactacaaaaacagaatacacagggaaggtaatctgaaggtgatacctttttcctatgatccttggccttataaccactaatcaagcctgagggccgaagttcctgcctcatctctgcctgatgttacgaactaggcaggctagcagaggcaacaggcaacctgggcacctgaagagctacctggataacctagaagaacagtaggaggttaaagatgaggacaagtctatcaaaacaaaagcctgtcaagaccagaaagagaaagtcacacttttgactttacagtttgtgctgggctgacacaaaggcctcagttaacaccaaatacaacttccatagacttcaagtttccctcatatttttcctgggtcactattccagagttgagaaactgaactacatctaatattttattaaaataaaattgaagattattagaaaagtttattagtcaatagtaaaacgttatttggttagctttcttaaacaatggcatttatagatatctgattatcccaacaaaaatcttcaaatggttcatggacgctttgtcaagcttttgtgccacctgagagaaaaaaagataaatggggaggtataatgttaattttgtagcctttgcttaatgtttatttttgaaatgcctatcattttctatcagtatctgaaactccatggatttctattagccttcaccaataattacatttgaaagcatccagaagagacaatccttaccacagtctcttttaaactcttaatggctgtcacaaaattctatttttcattttctctaagagcattctattaaactgttcctagttattagctttcataaaggcacacagaaaatgtttcctctacagccacaaatattcctaaagcagaatcatagtaaaacagctgtgataatgttttattcattccagaatcctaatgattgaacaaaagagagacagtcttaagagttaacatctattgagtccgtgactgcgtgcattgttctttcaagtattttacctgcactatttaatgtaattctcccagccactctgatttcactcattttacaattgaggagactgaggcatagaaaactaaagcaatttggctggagtaagggccaggttgggacttataccttggcggtctgcctacaaggtgttcctcaccaccatctgacactgctttctctgtgtagcccagagtgtcagcctcagtgcttcaacttgagctttcaggatctatttaaagatggaaaatatagttacattatgtcaccatttgagatgcagaaagacagggccaccattttgcacaattctgaaagcacaattcatgctgtggtttgtaaaaatggtactccctagagttgggcaatggacagctcacacagagatgcagtggccctgctaaactaatgccttacataaaagagttttactcttcattcccttaaatgattcttagtaacactggctgacacacacacaaaacagtttctaagtaggtctgtccgcatactatgatcactggtcaacattaagtttccacaattaattttacataatccaaagactgccaagcagtttatctgggtaaactaaacattctgtagtcatttattctgcttccagtcatgcccagcaacaggttgagaagacaaatgttctcagaaatgatctccaaggagttgggagcaggctgcttatacgtctaattcaccagaataggtgagcgtggtcgtggtgaccttttcatactgttgcagagctgagtatgaagagatgactcacagtcctccaatgcaacacaggtgaccctgcagccagattttgccttcagtggtatgtgactcccatggggtcaggagagtatctcagacattgaaatttgacctaatggcctacctacctgcacacgcaccctgcccacttacagaagggcaagaactctgcattactgaggccttgttattattatagttcctatttaggtaagaacgcaatggagaaaaaatgcatttggttattgggcctctgtttgaatatcctgtgctttttgccaaacaatgcattctacataatcttaaaaaacaaagtccatttcaaagaacaaaaataatgaccatatccactgagcaattgagcagaatgggaatcggagttttaaactctgatatatctgttttccttagggctgaaatcttcttttcatggttctagtttctctaattgaaataagaacctaaccctgttcaaaactacatctctgggaatgagtgaaaaattaatgatcctcctattttgttggatcataataatgactctcatcctggtggggccaccagcaatgctattcttctcagactctatcttagttcctaagccactcaccaggtatttaaaagaatgatttaacacaactagaatcatttaaataactgtattttttaagaaagccatattattgctttagtttggtcattcatatatccaaaccttggactcatcatcttgcaatctcatgtgttcagttattccagagaaaacattaaggagaattgtattcttcttcccagctaaattttaggtcctcaaagctggcaaccacaatttatgctttctaaaaatcatctatgatactaagtatgagctggatcatgaataaaacccttgtaacaataaatgcttgatgacttacttcatctcattagcaagggaaggtaactcataattatcaaggtactacaggaaatagggcactatctggaaatgctaaatacatctccttgcatgaatcacttcttaccagaattccctttctttccagatcccacctccagggttctgtggtccataccaggcactacattcctcaggggctacagcctatgagcgtctcatggggctatgaaaccatttgagacctggaaaatgaagtaattgaatacaaacagaaaactgcaaaatgaggactaacatttaattaaatgttcaaagcataagattatgtcgacttcaataattgtcaaatgagtattcttaacattttactaaattaaaaaaacttatgtgctgagttttttattttacaagtatctccaagtatgctggatgattgcaaagaaaatcaaggccagtcattggttaaatgagtttaatagtagccacataatttcaaaagcaaaattataaagacccttcccagactgttgatagcaaaaataatctacgttgtggaaagtgggtccatgttaatatgttagatataagtagtgaggcctaaaaaggtattaaaacatctttgcttaaggtactacctatttgcaagattgttattttaaaaatagcttatgttttaaattgttattgctttttatcactctaataagaatttatagttgctgtaagataacaagaaaaaggttaactatctgcagagatgcctgagagtcagccagggagtaacttaaatcctgcaggaatctgactcactgaagactgtcaactgaatgaaggcttaaatttcatggtcttgggtgggagaactttttcatattctttccccatatggaataacaatctgccctgaaaacagggagtattttggcatgatctctttttgcttatttgccttccattttccataaagcaacttttgccaagcaccatacttaagactcaacttttttgcaaaaatatcagacaaagcactgtctttaagaacacagagaacacactagatcccttcttctgaaaatcactgttctatgttgtttgtggatatttttttagcattcactgcatgcctggaatgaataggctgtgtttctccccaaaagagcacaaattaatatacaaggtcaggttaaatagttaagtctgctttcctatcccttatacagaagctatccattcaaaaaaaaaaaaaaaaaacttctttttactttttttaatttttaattttggtgcatacatagtaggtgtatatatttgtggaatacatacaaacatacaatgcataataatcacatcatggtaaatgggtatgcatcacctcaagcatttatcctttttttatgttacaaacaatccaattttaccctataattgcttaaaaaacatacaataaattgttaactatagtcaccctgttgtactatcaaatattagctcttattgattctatctaattacatttttttatacccgctaagtatcccacccttccctccacgctaccctacctaacctccggaaactgtcttctgctctctatctccttcgtttgttttaatttttagctcccacaaaaagggagaacatgtgaagtttgtgtttctgtgagtaacttatttcacctaacataattatctccacttccatccgtattgttgcagatgacaggacctcattcttttttatggctaaatagtactacattatatatatgcaccatattttctttatctatttgcctgttgatagaaatttagattgcttccaaatcctggctattgttaatagtgctgcaataaacatgggagtatagataactctttgatattttgactttctttcttttgggtatgtacttagcagtgggattgctagatcatatggtagctctatttttagtcttttgaggagtcttcaaactgttctccatagtggttgtactaatttacattcccatcaaaagtgtaccagggttcccttttctttacatcctcaccagcatttcttattatttgtcttttgcataaaagccattttagctggagtgagatgacatctcacaatagttttgatttgcatttctctgacgatcaatgatgttgagcaccttttcatatacttgtttaccatttttatgtcttcttttgagaaatgtgtgttcagatgttttgcctatttttaaatcagattaattttttcctgtagagttgtttgagcttcttatatattctgattattaatcccttgtcagatggatagtttgcaaatatttcctcccattatgtgggttgtctcttcactttgtcaattgttcctttgctgtgcagaagctttttaatttgatgtgatcctatttgtcccatttgtccatttttgctttggttgcctatgcttgtagggtattacttaagaaattgttacccagtccaatgttctagagactttcttcaatgttttcttttagtagtttcatagttcagagtcttagacttaagtctttcatccattttgacttgatttttgtatatggcaaaagatagaagtctagtttccttcttctgcatgtggatatccagttttcccagcaccatttattaaggagactgtcttttcccaaagtatatacttggcgcctttgttgaaaatgagttcgctgtagatgtatggattcatttctgggttcaaaactggtattccagttttgttctttttgctcgggatacctttggctattttgagtcttttatagtttcatataaattttaggattttttttctatttctgggaagaatgtccttggtatttttatagggactacattgaatctgtagattgctttgggtagtatgaacgttttaacaatattgatccttccaattcatgaatgtggaatatctttccatttttttgtgttctctttttttccattagtatttgatagttgatagatcattgtagacttttttggtttagttaaccctaggtacttaattttatttgtacctattgcaaatgggattactttctccatttctttttcagattgttcactgttggcatgtagaaatgctactaatttttgtatgtttgttttgtatcctacaactttgctgaatttatttatcagttctaatagtgttttggtggaatcttcaggtttttccaaatttaagatcatattttctgcaaatgggataatttgccttcttcctttcaaatttctttctttggtctgattgttctagcaaggacttccagtattattaatatattgaatactagtggtgaaagtgggcatccttatcttgtcccacctcttggaagaagagtcttcagttataccctattcagtatgataccagctgtgagtctgttatatatgacttttattgtgttgaggtatttccttttatacccgattttttgaggatttttatcatgaagggatgttgaattttatcaaatgcttattcagcatctgttgaaatggtcatatggtttttgtccttcctgtcttccttttagtaaaagtgattttctctggtggcgtgttttaattttttgctttttattttttgagaacctgttgtatattttttgatttgcgattaccaggaggcttgtaaataatatattgtaactcattattttaaactgataacaacttaacactgattgcataaacaaactaacaagcaaagggaaaaccaataaaaactctacattttaactttgtcccccgctttaaaactttctgttgtctttatatcttattgtattgtctgtatttcaaaaaatagttgtagttattatttttgatcagtttatcttttattctttctatttaagatatgagttgtttacatactataataacagtgttataatattctgtgtttttctgtgtatttactaatgctagtgagctttgttcctccagatgatttcttattgctcattaatatgcttttctttcagattgaagagaattctttagcatttcttacaggataggtctggtgttgatgacatccctcagcttttgtttgtttgggaaagtcttgatttctccatgtttggagaatatttttacaggatatactagcctgagataaaagtttttttccctttagcactgtgaatatgtctcctgccctataaggtttccactgagaagtctgctgccagatatattggaactccagtgtatgttttttctttattttttcttgccgcttttcagattctttcttatctttgacctttgtgagtttgagtattgaatgccttgagctagtcttctttgggttatatctgcttggtgttctataaccttattatacttgaatattgttatatttctctaggtttaggaaggtctctgttattttccctttgaataaattttctacccccatctctctttctaacttttttttaaggtcaataactcttagatttgcccttttgagactattttctaagtcttctaggaatgcctctttcttttttattattttttcttttgtcttctctttgtattttcaagtaggctgtcttcaagctcacagttctttcttctgcttgattgttttgtgctgttaagagactctgagacatttttcagtatgtcagttgcgtgttttaactccagaatttccgcttgattcttttaaattattttaatctctttgttgaatttatctgataggattctgaattccttctgtgtgttatcttgaattccattgagtttcctctgtctaaaaggtcacatatctctgtctctccaggactggtcactgatgccttatttagtttgtttggtgatgtcatgttttcctggataggctttatgcttgtggatgttcgttgttgtctgggcattgaagagttgggtatttattgtagccttgcagtctgggcttgtttgtacctgtccttcttggtgaggctttccagatgcttgaagaaacttgggtgttgtggtctgagttttgggtcactgcaggaatatctgcattagggagcactccaagcccagtaacactgtggctcttgcagaggtaccaccttagtagtcttggataatatccagagtcattctctggattaccaggcagagactcttttttctcttctcttactttctcccaaacaaacagattcagtctcagtctgtctgtctgtctgtctgtctctctctctctctctctgtgtgtgtctctgtttcctggatctgggggaggggtaacacaaatacccctgtggccaccaccactgggactgcatagggtcagacctgaagccagcatagcactgggtcttgcccaaagcctgcagtaaccactgcttggctcctgcctatgtttgctcaaggcactagggctctataatcagcaggtggtaaagccagccaggcttgtatccttcccttcaagacaactagttcctcctagtcctgggcaggtctagagatgacgtccaggagccagggcctggagtcagaaatcttaggaatctaccggtactctattctacggtgggtgagctggcacccaagtcacaagacaaagtccttcccactcttccttctcctttccacaagcagaggagtctctccctgtggccaccactgccccaggcctgcgacaagtactgtctggctactgctgatgttcattcaaggcccaggggctcttcaatcagcttgtggtgaatgctgccaggcctaggaatctattttggggcagtgggcccacctgtaagccagggaaggtccagaaataccatctaaagccaagccctggaatcaggaacccctagaacccctttggtgctttaccctgctgtggctaagctggtacctaagctgatttttggttcttatgaaggtgcatgaaggtgcttttttgtgtggagagttgttcaatttgttgttcctttgggaggctgctatttagccatatggctccacctccctctccatccaaaaagaaaactttaaatgaaaatatacatccaaagaaagtgtttttgaaataaaaaataaatggtcttaattccaaggaaagaaccaacatagtaaagtaaaaatgcattttttccaaaagttacttgtttgatcacatattgtattttattttaatgaaatatctagaataggtaagtccatagagaatacaaaacaggttagtagttgccagggaatgtgagtgtgcagaatgaggagtcattgcttaatggcactgttttcaagagttacttttgagtacacttgcagtctggtatctaaataattgaaatatttgaaagtcgtgattcctagaataaaaacagtgactaacttttaatgatttcaatgtcatgtgcacaaaaaaaccatgtccagagtaataagtttacccattctaccattcttttcaaagaattgcttaaataagttttaaaaaatttcctattgagatgttacttaaaatacgatttgtttagttctcaaggttatgctttccccaggttatgcttcatttgggtaatctaagtttaagtcctaatgtaagacctagggcatggtacttaacttcctgtagacctcagttttcttgactgtgtggtggaagaaataatagtacctagcttgtgagtttgttttaaatgttaaatgagagaacatgtggaacatcttacccagtgcctggcacatggtgagcaatcaataaatgggagttcatcctgtcatcttcagatttctcttctggagccagccaggcttgagttctgacctggttcatccactgaacttgtaggggaagcacttagtgcccttcggtcctctcatccagtacatggatatacagtcttcatgtggttgatacaaatacgaatgtgctaatgcatctttaccaaaaagagaggtaaaagaaaggaaggataatcctgccagagatacatatgcaaagatctgaaagtaatcgagagtgaggggttgcagattggacaacacttagtagtggctccagataaggttcttaaagactggccaggatgcagccttttcatccagagaaacagccatctcattcatagacagtggtgactgattggcagattttataagatgacacaaacaccctccccattgtcctgccaaaatgtggggaaactcttcctggaaaagttatttctttgaattgagcttccaaaaggttcctattagaattcaaatactctgtctgggttgaatatcacattgcataatagtttctccagattaaggccatttttcctaaatatttaacaaaaaatttttcgcttcttatcaatgatgctggcgttggttcagtgcctgcataagacttcttccagtgtatttctttaccctggcaaccagttcctttttctttgggagaattttttttttaattataacactattgtaggaactcctttttggcacagaaggcatctaaagtaacttttagagatagaggcttatgaaaaacaagaaagaggcaagactcagtttttgaaatctaattccagccatgaagcaaatgccacaaaagggcacaggaagaaaatctgtaaagggcttatctaccaccgttgaccaaagatttattctgctgttaagcaaataccttgtaagccagatattgtgctaggtattctgaatacaaagatgcagaagcctcattccctgttttctttttttttttttttattatactttaagttttagggtacatgtgcacattgtgcaggttagttacatatgtatacatgtgccatgctggtgcactgcacccactaacgcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatgaacagacacttctcaaaagaagacatttatgcagccaaaaaacacatgaaaaaatgctcatcatcattccctgttttcaaagaaactcacagcattatggaggcccaggtttctatttgggcctccataatgccttgtgctctaccaagaatggtaaaacaatcctttccagtaggagttcctagttagtggcttatagttaaccaaatgaagagaggatgaccatatggtgctgataaattgaaagaaattaggatgaacatctagagatttgcatggccagacacctaattcagattgcagagcagcaggatgggaggcgtagtcctgatttaactcttgatcaaaaagaggggtaaaagaaaagaaagataatcctgccagaaatgcgtgtgcaaagatctgaaagtgatcaagagcaagggattgcagattggacagcatgttttctcatttaatcccagaggaaccctgggaggattctaggtgtgcatattgtccttattttgtagaagaaggtactgaatcttaaagagataatgtgttttcaaagcttacagagtccaaatcgatagctaaacagtgtctgtgggatttgaatccccctgtgatgttcactgtgtgttgccatatactgcaaatgtgttataaaataataattataataaacaaaattaacctgagatattcccagattgaatcaatccaaggagactgaacttctgagtttgtcttggagttagttgggctttactgctacttatgctagatcttgaaggcagagtaggaaatatacttagcagggaagtgggagaaaggtgagaggttccccaggcaggggaaacaaagtgagcagatttggggcaaggtgtgtgagattgtgtggttggcaatatagggtgggaaaaattagttatcaagggcaaagctgaatagcagattgaacccaaatggtagaagtttttatttaacacacaaaaaaggctgaaattgatcctgtaaggaatatgaagctatagaaggtttttcatcacaggctttgacattttaaggtttgtatctttgaaagataatccaaagataagagaaaaaaaccttagatgtgtaaaatagaagtcaggaaaactacacaagctatgtgtaaagggagtcaaggggacaggatccaaaggaagacaaaagcacaaaccaattattttaaatcaaatactagtgcagtaacatatatttttaagttttaaagctgcttttctccatagcttattgattactcttttaaaacttatttttaatagcagatattatttattgattccttaccattttctagatactttgctaaggttttacatgtcttttttagtcctcagaaaattctcttctatctccattttatagctgaggaaactgaagccagggaaggttaaataatttgtttgcaatcaaacaactagtgattggtggaatttggatttgcaaccaggcagtctgactccaaaggcctcttcttaacttgatcctacatacccttcctaaatagtaggcgtttttctcagagcagctgttttacattagagaaaacttatttgtaatctgtgatcaaggagaaactgcctgagttgcctggattattttggcatttttaatatgtacaagaaaaatgttatcaaataaatgtaaatttaaaggtcctgatgagagtttactttctaataaaacaattttcaacatttcccattacatcagaaactaaattattattaaaacacatcttgtgttcatttatttttgacaggctgcttttcacatctttttttttttttttttttttttttgagctggagtttcactcttgtcgcccaggttggagtccaatgacacgatctcggctcactgcaacctcctcctcccaagttgaagcaattctcctgcctcagcctcccaagtagctgggattacaggtgctcgccaccacacccagctaagttttgtatttttttagtagagacggggtttcaccatgtttgccaggctggtctcaaactcctgacctcaggtgatccacccgtctcggcctcccaaagtgctgggattataggcatgagccaccgcgcgcagcctccaatcttattttaatgaaaatctcaatttatctcagtgttagaaactagggcttcatttggcaatgtggtctttccagttgtttcatctctttcaaaagtcttttaagaattattgaagtaagttaattttaaatttttgctttatcccttgagattggtatatagagttaggaactacttgattaaatacaggaagctactataaatttgaaataagaactaaagttataatgtgaccagactgggtaagcactgataacatttgtatatatttaaacagaaaaaaaatagttagaagaataatttttaaaaacacacaccagatgttggtaaaggcaaagatatttttgctcttgactttgtctatgaaagtcaagtgaatactttgaaagaattgatgatggataaggcaagtacattgatttctcaaggtgtgaattgttatcttcaaactttgtgcttccataattgttttttctttaataatgagacatctagaccataactggctatgtgattctgaatctacctttacaacttaatctttgtgattcccctatataagatatctagagtagtcaaattcatacggacagaaagccaaatggtgcttgtcaggggctgggagaagaggagaataggaagttactattaatgagtacagggttgtcgatttggaaggatgaaaaagttctggagatggatggagataatcgttgtgcaacagggggaatatacattacaccactgatcagtatacttagaaagggttaaaatgtcaattttacgtgatgtgtattttaccataataaaaaatacttaatatttacctatgcttagagagagttgacatatagtcatttgataaataaaatttgtaaatgcgtatgcttagataaacatagaaaattgttttaaagtagaacttatagatttctagctttaaaactgtggagaaacaatcttcctatgccatttttttctttaaaaagtcactcaaaccaataattagtacaaaaaacagaaaggtacatttcatctttgaggaaactgggagatgtctgtgactctaagccacaatacataaagatagaagtaggaagagaaaaggtcaatgacttaaccaaatcagagaacaatactaaagtgaagcaaactgagctgccccagtcgcccaaaacatactttggaagatggaagagttctaaatatagcaggtgtatgaacatgtatattatatacacttctccataagccctcactctttttcagtgtagtcaacatattttgcatccctctccatggaagacagagactttgggatactaagcaaagagtaggagaaggatggctgtatgtttaactttatttaggacaattaaatgaatgtctgcaatgtgtcagtaagaccttcagcgtccttctcctacccacaccagaatgctaggaagcatatttatatccttctctagaaaaatagagataccccagaggaaaaaatctcttacaaatagtaacatttggaagaggcaaaaaaaatccccactgggcacttgatgatactgcagtaaaactcccagtacacaagcctcacccatgcacttagaacttactgtcacctttctagggtctcattcttgtgtatgaattgggatcaggaatcaatgctggagtttgaggatattacactcattgctctttgtttacattatttacatgtatttctttaataaaatttaaatatttaattcaaaataatgttaaatttgcagagattcatttaagtttagaataaagaagaacaagaaatgtgaaagagggacaagaggagaggcagaatgcaaaggaaatacagcagcacttagaaaattttaaattagatagtttttcttctgaaatccagtattgaattagtgcaaaattctgaaagtcaattacaaaattcattttatgtcaacattactgactccatgcacaaatgtttattctagttttaaaaactagtattctgtaccttttaatagccaatgtaatttgttgacaaatattgaaatttatacgttaccagaggtctcacgtattgttaccttttaaaatgatcatttattaaccagtattgcctaatgaggcaatcaaaatgtcatctgttgcataggtaacaggaaactaccattactcatgttgtgagatggtcaaagaccttatcatattttatggctaacaaactcatgatgttgtcatatatgccctcatcacagtgtttatgatacctaaaagttagtgcctaaaaattagaaacaaggacagtgaagttagattgtttaatcctgcatatcttaaagatctaacattttctagctgttaaatatgtttatcattatactagtaatgtacgtgcaccatttttattatattaattcattgccactgtacaactaaagaggatggatgaattttaaaaacttccaaaaacttggtagcattttttaatctctttctcttcctcttttctttctgtcttccacacacacacacacacacaaacacacacatacacatacatacatgcacacatacacatcatgaagagcaagctttggaatgaaatatacctgggtccaaaaattttgaacaaattgttgactttctttatgtatgaaattattattatcacatctactttggagggatgttgtgatgtataattaagaaagtatagtctacttagcatgtaggtaattaataattagtagttattattattatcctaacctgacagtttatgaaagaggtaggaaatctgaagataggaaagccttcaaaatataatactccggacttctcctttgggaattaagaaatgtagctccaagcaaggttcatgccagtaggaaagtccttgaatccaactgtattcctagtaagtgtaataaaataaaagaaacctctagaaattgcctcaaaattcccctccagataaggaaaataacacaatatttctcaataatgaggaactgctacaggagttcagtgtcttattctcattaacgttagagtacaatagagaatagcaggaaactgtaaaaactgcagtcccctggtctttttttctaaaaagttagtttgacatatctggagtactgaatttcagcatatttgagaggcctgaatatttagttgatatataatatggctctaagaaatatgctcatgatagattggaaagtatagaatatctattgtaatctgaaaataggaatttagagaacagaagatttgatagtaggcagagtatttgaaaatagtaatacttgagaaaacctgagttgtatagtaaaattactccgtaacacctcattcagttggcttcatttaatgtttaatgtttaatccatggataaatgtcataagtctcacaagtcacgctcaccattggatgataagagaaagggagatcacattttaggtgcgcacaatctacctgtatgcaattgacgctttccatgtaagtgttgccaagttgtatcggggcaccattagtggtatgagacagactttaggagttattttggactcctttttttctattaatatatcttatattttgggggcaaattataccagtatattaaatctatttacagaataaatataaagttaccttttatattcagtttaagtttttttaaaaagtgagtcaattaagaaaaatatcaaatcatggtatagatggaatgctaatatggaaagaattatgaaggtggtgttatgactgaagtttcagaaacatcaaatgacatagtcatttgattcaacaaaacatctacagatggatgacccaatggatgtatacatctatggtacagtctattgaaatgtggtaacaaccagaaagtaaaaggtccatacattatacaattcagtacaacagggaaatactgagaaataatcgcagcttctggatcaaaagcatgggccacatggttcctaaatccagtctccccatattcaggcctcctcatcagcctgcatgccatcatatgcttgcatgctaacaggaatttcgagggaaatgccatatcttttccatttggggaagcttttcagagggaaaactacaggatgcttagataacaaaacattctttcagaaatgttcatgtgagaaatggtcttacaagtggataaaactctgtaacatcaaatacatactttttttttattctgtcactaccttaaatattaggagtagaagcaaaacttaaatttaaatctcaatggtcttacaacatagcgcatctttctttctctgtaatggcaaccttgatgtaccaatccaaaaactttgagtattctggttagttccatacattgtcagattccccacttaagtttgtttttgccaggggagagggacgatttcttagtcattatggtactattatacagtctttagtagatgcccaataagtgtgttaggttttcagagaaagattcttggaagatgtagaatgttgggcaagtaagcaaggaacagcacatggggctgcactaaacttgtgtgtgtgtgacagagaagggagtagcatcaggctaaataagctcattgtaacatggatctgggggacggtagaacacaggctaattatttctggagagttgaaaactcaacagtcagacattacattctctgatcattgtcatttgctttctgaaatggcaactggaagctatttggtagaccttacatggagggaacagtgtttcaaataaatagtagttgcctaattttacttggtttgcttttgttctttcttttcccacatttaaattccaataagaaaaaaattaaacctcttcctctaaatcccctctcccctaaaaataattagtctcacaaaacttttaagtttccaaaaaaatacatgattaattaacctgctttaaaatgccagcaatatactagacatgggacagtgctaagaaagtgtgaatgtcccctggcagtcataaggaaactgaaaagcttaaggggataactatgtggaaagcaatttattggcatttaccgtaagaggcctgagagtcattgaaagaagactaagtcacaaatgcaccttgaagtgtgaccaggggagcagatgaagggtttgttgtaagaagcagccagagcctctggcggatgccgtactacattttccaagttgtttgggtgggtcacaactgcactccaacatcctgtctgcaaatgctaaataaacaccaagttcacgtcagactagagaaccaacgtactagctaatgccatttaagcaatcagaatgcttacattattttcacttggtaattcacatccaaaataattgaagttggcacacccagaggagtatatatcctctgtgtagatgttcagagagataggcaggctggtcaactgttccttctgttgggagcaattggaatcagcttagattatatctactgtaatagaaaatattttatatttaggaggtgggaaaggttttggccttcgaaataataagagatattgacaagatataaagcttcattccttactgaagagctgttaaggattagcaaacccaagtctttgtgtgtagagatgaatgaaatttgcattttttttaaaaaaaaataaggtttagaaaacattgtgcaagggaacagccttaatacgtgcagccacttgtccaggaataatacattcaatttttcagtttaaaattccagtatgttctgatccaagggtgcctgttacactctgctgaatttttaagaggtaatttacatctctacaaccaactccaaagcatgacatttcattacatccgctcaaaatgaacagctgctaagtcatcaagttctctcaactttgcttctaaagagaaaagtttagttttagtgcttcagtgaaatacttttttgaaagaatgacttttataaaattcatttgtttattatggtaaataaacaacttaatggcaaggggtgtgttccttgtaaaggtgatcacggaatgttacccagaataacacagacatctcatttcccagagaaggaaatggttttataagttttgtgaggtctcttgtctgcttggccggtttacagtgctggtctctggagctgatccgcccctttgctttgtaagtctcagcaattgacgaggctaggctgggcgctgggcttttctttttttttttttttttttttcctttctcactgccctgcggtgttttgaactgccttcttacagacgtcatacagcccttgaggaatagtttctgcctggtgagattgaatgatagttctcattcacaaaaccctggattctaagcagggacacacagaaattactttcgcaggtaaatcagcccacccagccaaagtgtggagagatttgttccttggctgacttctttgctccacggagaggagtgttttcctgtgcttgccctgaaatggaacttccttgacagctctcccgtgttacagtacctcccggtcattttctttttctctctctctacctgcgctcttcgagtgtcagaaacctttaaagctgttactatggaattgcaaaaaagagatcaagtgactctttcactatgctggtttcccttgtgacccagatgaagaatcaattcagaattcagttcctcccttggcattgcaagacacagaagaaactgtcacttcctaacagcctagtactggagtaaattcagtatgaaggaagaaagcgctcctgcgtgttagaaccttgcccatgagctggaccgaggacaggagatggactccaggaaaattggatttcttcaagcagcctcccttggaaatggaatatctttaaaatcttctttgcagaaagacagttagaatgtattaatcagaatagttgaagacttattttcctttttattttttttcaaaatgagcattattatgaagccaagatcccgatctacaagttccctaaggactgcagaggcagtttggtaacgttcttttctctcatgcttttccccttttctcttttaagattgacgtactccttgagtatttagtaagttgtgtgatgtcgaggctttgtgaaagaaggcagtattggcggctcttttattctttattttgttcccaaactcatgtgctttaaccaaatgggtgctgattttttttttaattcctcttggactgtaacaatttatctgatgataatttttaaaggaggaaagaaacttgcagatatgttgggagttttgaaaatgaaaacttgtcatttttcagtgtttgattcagttgcttgttttcttatcttctttgcttgctgcaagcaggctggtggttgacaggctttgcccttgtctttaaaagcaataccctcacttttagcacagatgtgttagaaattaataatgttatttatatttaatcatacacatgaaacaaacttgaatttaactatgtggctaaatgtatatcaagttgcttatcattcattcatctcttatgttttattttattagaaatgattcctagtaattatatttttggttattttaatgcttttactctgatgaaaaaatatgtcagtttcaatgtattctaatgttctattatttccccaatggtgatttgatatgctaatcagcatatggcatggcccttaaggagtattttccaacaaagtaacttttttttctacaataggtatttacaaaatacttttatggctattttaggggttagtcttattttgtttttcttagtgattgattataaataactaagctcacctctttgaaatggaaataatcatacctcacactggggaaataaaagcaatgattgaagtgaggtggttgagaatgggaggaaaacaggccagcaaaatatgcattatcatgtgagcaggcaaacacacatgtaaatactcaaattatttgcgtcaggaatttagcttgtgtttttgtggataggttagcctttgctgttattgtagtgttttacagtcaaccagaaacaagaattgccccatccgcagtatttctgtgagttttaataaattatagatgaagattttgtctcttaacgttacttgccatttcttacaaaataacacgtgcaataaattattccttgagtttatttaaagaaaagattgcatctgcaaacaaatttggagagtcctgtcctttttttcctcaaacaataaatactggaaaatccttaaaatccttgtatgaattaccatagctaatataaatcaccaacatgagtaaacagaatttataatatacatgaatttaactcatttataatttataccattcctatgtgaaaagatgttactactttaaaaatagtgtttaaccaaactatttctctttttgtctaaactgccaggagatgtattttcaaattcaggtttcaattggaaataatttgttcatttcaggagatgagtaacattgacaccctttacctctctgagattatcatagtctatttttatccacaattattatattttttgttttaaattgtatgggatattttcataagtcaagccacaatttaaaatgcatttttaaatattttgatttgttaatgtgtgtatttttccatttaactaaaaatattctccatagacttggggatagaatgatttctgtgtaagaaataaatctctctctatatatgcatgattcttagatttaactacacactatagaaacctctccagttattaatcttacatctgacttaataatataaccgcttgggtatatcactgcagctgccaaaaaatttggcctgagggtataatcagctgtagtaacagttttgccattttattatccgtctatcagtcaaatattagacacatctattatatttatttatttaattacatgtataaaatcaatatagattatagatttggtatatagagaaaatatatgtttgtgtgtatatatatgtatacacatacatacacacacacatgtttacttgagcattaaaaaaacccaaacggcctctcttcttgtgcctctgcacataaaggccacaggcctcaaattgctcagagggacaatgttttctcaccagtgttgctgtctgcatttctccaccaccaccctaccctcattccttttcagttgacttcccatgagagagacctaaaactttgccatttatctctttttcagatgtttatttgtttccaggttgatctccaaaatactttgttcttgggacacatctttctggctttaccatcttcactctgattacataaatctattttgtgttccattggtctactttctccaaatctgtctactgtcctccgggattccctaaagccaaacattacgtttggaagtttgttgtattgtgcaagaatccaatgttttggattacttctttacctttttctatttgtttctctccaagtatcataaaaagcagtccacactaacttgtccttacagccttaattaaattgctatgagatattcacattttaaatgggatttcatggcaaacttgtattttatacccttcctcttattaaaggtcagcctgttataattaaaattttattaatttcaagacaaaatacaaataaccttaaaattaatctatttgtctctttgtaacataggtgtccaaatttagggtttatttaataaaggtgtatactaggttgcttttatttaaggaacagttatttatatgccacgttctagcagaaagtgattatagtatttattcttaagcattattttaaaaaaatgtgcctgcatgaaattgagaaaaactttatatattttcttatgctcataaagctaataaaattagcagattcattgattgcagaattgtttgcctttcttgcatatcttaaattcagatttagtcagttgttatatactatgaaaatattaccttacatattccttgatatctctttaacacttttataaacatttataaacatttcccagggatacttctcattaatgtaattaagacttgtgatttagtttaagtaagtaaaacattattagtcttacaaatataaatataaagagaagtttagtcaatggaagtggacttttttctttcctgctgacagaacagtgtttaggatttatgtgttacatgtaagatcattcattatgtaatctgaaaataaaagagatgctactgttcaaaatatgactgtggttgtttttaaagcaaattttaaaattggttattgtatatgtaatagtacttatacttttcattataagtattattatgtaataagtatacatgtaatacttaggtttgtagatgcagaaaaaattctggaagactctgtccaagcttttggtagtggttattttttaggagtaaaaaaaaaaatggtaggagtgaaggtaagggggactgcctctcttttcttcactgtatttgcatattgtatgtagtttttatcaataaagtattatatatgaaagtttaaaatattaaaaatatacctactatatgtattagcaagctcatctttatatatgccaatatctacttagacattaaaccacaatttgctcaggttatataatatgcaaatgagtatttcagtactggttggatacaattttctgaattttcttgcaactctgaccaatggaggattataatttttttattagctcttttctcttaaggttgtaaaaatctagactggcttagcattcttattttggcctcatgatcacagtggaaagcattcatataagctaaaatgtccaattttataattgagaatcaaaaagatggaataacattaatatgttggaaggaaaataacccattaaccccattattccatcctcagttattctcattttcaacttaccttacatatcttaaatagctgtaaatactatttctgtactctgcttcttcatttaacatatcaatatttttctatttttggccaggcggcgtagcttgctcctgtaatacctgcaatttaggaggctgaggcaggcagatcgcctgaggccaggagttcaagaccagcctggccaaaatggcgcaaccctgtctctactaaaaatccaaaaattagccagagtggtggaacatgcctgtaatctcagcttcttgggaggctgaggcatgagaattgcttcaacccaggaggtggaggttacagtgagccaagatcgtgccactgcactccagcctgggtgacagagcaagactctgtctcaatttaaaaaaaaaaaaaatccatttttctaatacttatagctttcattttattgagtgtcttatgaaagagctctatcaagaattttacatatatattatttagttcttattacaatattgaaaagaaggagttgttaatcctaattttacaggtgagaaaatgattccgtgagatgaaataacttgagcaaggtcataggctggggtaacccaagtctgtctacctcaaagaacgtgctctggttcttcagcttgttgccttcctctactgtggatataattatctttttaatggccataaaagtgttcatgttgtgaatatttctagatgcattacagtatttggcagttttcttttcggaagtatggtagcctatgaaattcagggttgacgttgttggttgttgaaaaatagctttgtgaaagactgttggttgttgaaaaatagctttgtgaaaggctcttgcagcttgtagaccattatattctctactggtagcaaataaggtcctctggtctttataacagacaataaagaacaaaaggccaatgcctcacaattttgaatagattatctttccaattctattaccaagtttttctgttctctgcaagctctgtaaggcttcaggttggaaacaagtagtacatatcagattttgtatgacatctaagatcagctttgaaaaaaatatgcaatcttccttcctatttcttctatcttagaaacttgtaaatacgcaaacaaatggaattctcatattttctgcctgtgcaatatatattatgatttggtttaggtatgtgactactgtcaaagttggttcagggttttgagcatgaggtaaactttttttggtcctattacccaagttagtgatgtatctgttatgaaatatacttaaagatatacagcttttagaaatgattaagataccttgaaatatttgatgtatttaaaacataactagaaagacacagagtggatcacagataggtttactctttaaagtcatgaagtatgagattccctggaaaaagccatttgtccactgtacttctaacatgctctgtgtccctggaggagtcacctagtccctctgaagccaagtctactgtcctgtaaaataaaaggggcaaggcaggtcaatggattttaaacacgtttatttcaatgggacattttttattaatgaaatgtgagttgaagttaatataaatgaatatttatactgtaatttttagatataaaatcatatataaattcaatatatagatataatttttaaaaacatagatatgtgtgaaatatataagtaaaaagtataagcacacataaaacaataaaacagccactgagtttgtacatttaccccccaccccaaattcaaaccctctccttaaaatacctctaaagactttaggattccaaggaatattgtttgaaaaccactaagctaatgactgttaagatcacttacagttttactctctgcagtgctgccttaccgcgggagagtcatttgtgtattctgtatctctatatggattgggataaactcgtaggtaatgtagcagttcaaatacctctgccttataagaccttgaagttatgtaacttttcccacttctgagatatcacagaagagttatcactataatagttaagatctattcattttatttagcatcttattttttacaagtttattttaggctcatctggaatgagaaaatcatgcactaaacactgtatgatgcatagctgataattcaggaagtgagtatggttgttggtaaagaaatgctgaattggtatgaaattcttcagaagcaagacgcttcttttggtatttcaaaatggggttctccaccctctttttctatcatgtcaactggctgtggttatgtgtgcaataatacttagtcctgactgcaactcttttttttttcttccccacggatctgaggcacaccatggttttggccttatcattaaaacttgccttttaggagaggtaaaggaatagctcacttagtagttcctctgtcaatcattccaatcatgtagtgaattctattgaatcagaagggatgatgacatgaaggtaaccatgagtatacgaatggttagtcatggatccacccaaccattactagcaagattgagaaaagtagattctaagatgaaactgaaggggaagaatattaatgaggcctttaaggagtttttaagctttttagggaaagatgctgagcgatatgtataaatattcccaataatactaatactaaacatatagaattgtcaaagtttagataaaggtatagagaatagggcctgagggatattagctaggttggtaaggaagatagtcacaaagaaagcacagtcttaataaaaaatcaatatagattttcttggaagcctttccagaggtgatccaatatctcaaaatataatacaggggttgaaggtatattagaaaatggacagaagtaaggtatacttcagccacaagcaccaaatctctccagggattggtgcctatgggaagggctggggtaccacatggggcacaatgacagcaagcctgggtgagacactgttaaatataactgtgtacaggtaactaactaatgagagcccgtgccagtgatatgtctcagctctcaaattgcctagttctttgtcaagtttgacctaaattagaaagcatttcaaaagtatggaaagtaggaagaatgccagaacctatggatgcagttttttagcatgacaggggcaatattgtaagtatttattatctgtcctaagccttctaaggggattggctccctaatgagcatcctgggtgatggctgaggatgcgaattagagaagctaacagaagggtgaactgctcttcagaataagagttagaaaaacacaagggaatatttcaagagaagagctggggaagtgtggcaagaaaaaagagattatacagagaccaatatggaagaattccagcccagtttgaactaagcatccaccatctagcaccctaccctgtttaataacactggcaacctctgggcaaaagctgccattaatgaaactcagtgtagaggacatttgccccccatctcagccctaagaatttctgccatagggtaaagggggtcacctgcaagcccttccatttccctactacacatgaggaagaataagaaattagaaaactagaaactaggtgtagaatgtatgcacaccaaggattgcatcttccaaagtacccttataggaagcagtcctgttgttttaaacccacagagttaggaagttttctttatatctaatacaaatcttctttgcttaaattctaacccatttcctcttagttgtcagtagatataatgagagtgaatcaatagataaaccaattcttctttatggcctttgaaaactgctagtgagtgacttcttggtcttttttcatttcatattgcaaaatattcattctaaattgtaaaatagatggcaccagtgtgacttgttaaaataaatgtttcattaaacataatttcagtatgtaattgttttcagacttcctagagaaaagtgctcccgttgtatctaattctctttcttgtttaaaatacatcaaagatgagaaattgagctctttttagtgaacttgcttgagacattcatatggaatacagaaaataataattcctaacattcaggatgtcattccattgcaatgtggcacagagttttttctttgcatcaaggaatttatatgactgatactattttagtcaggataaattactgtaaaatgtgtccacttttaaccaatggcattctaacatgggataggcaacagcgggctgtgatttttgctctgatactgcaactttgttatagaatagcaagtaactgattggcagctagatcaccagctagctggagaaagcagcttctaggtctatagtcatagttggagtcataacctcattaatgatagctacaatgtattgggcatctactctttgacagacaatgaacttagtactatatacagttgaagcaactgtatgaataaactgtatgaataaaacttgaagtcgcacagcttataaaattacagtgctgcagaaaaatcttggtctgtcgaaactacatcccatatttgttgttgttgttcttattgttttgtttgcttttcctcactatctaaactgctttggctacacatagttctgtttcatggtattagaaaagtagtcaacaagctgctacttatacttttccttcctgtcctagactgttcaagtttcttcttttaatcttatgtatatcaagaacatgtttgcctatggtatttgtctgcctttccccccaagatttgtatacaagcctccaaccgtgagccctagagatatattgagaaatagaacatggactttgacacggctccattccttggagatctagctagttcctgactcgttcagcttattgactctcttcctctggtcagactataaattgcagttttccttctctctggcatttgaccagttagtagcaccataaaacctttgaaataaaagagaccacagagaataacctataatctgattttccccacccctaaccccaatgtggagctggaaacattttgctagtctttaacatttccagtcaagtagggtcaagaaaaactgttaaaaacaatgtcaatgcttaagtggtaaaaagatttgttgaagaatatatatatatatatatatttagagacagggtctcactgtgtttcccaggctgaggtacagtggctatttacaggtgtgatcatatgcactacagccttgaactcctagtctcaatcctcctgccttagccttcccagtaactgggactacaggcatacaccaccatgcctggctggagaaatatttttttaacttcaaaaatgaagtttgagctgaaaaagagagctaaaaattagtctgtcaggcaaatgtgtgaaagcagttctattataatttgtattgagctataatgtaattcctaaacttatgtcatatagctaagtaagtagctgtaattcgcatcttgaaattttaaatttacttctttcctctcaatatagtcttcatctgaattaaaaattgtggcaatttgtatttattgtgtacttaactatgtgccaggcactgtgctgttcacttgacctaattatctcattagatcctcatgatgaatcctagacagtactcattagtcttattcctcagactgaggcctaatgaagtaaagtggcttgcctaaatttgagtggcaaataagataatttcatgattcgcatattttcttaattataaaatgttacctttagcaatgatgtatatgttaatatgttcaatgagttgatctacctgaagtgcttagcacatggctggctccttgtgagtgaccaggaactgttagcttatattatgcatttttgaagtttacacattggtatgactttctaaataatcaagaactctaaatgtgaaagctgattcattttgtaagggtttcttttccataaggtagtcttttttaacacagtcagaattaagcatttatatagagctaggtattccagataaatcacgttaatagtgtgattcaaagaagacacactgctatctaggtgggtcaaagaagtaaactacttagtggaggtggcaaaataagaagtggtcagtgggaagctaaaccacctctgatttagttatttaaaactcaatgagaaccctctaaggaagcacaactaggcaggggtttcatctgaaaggaatggtcagctacctgagcattatctctaggtgcacctttgtaaagactttctccatgtatctttcctactgggtgccaccctgtggcttggtcctacggtaatcacactgccaggcattctctacctctacaaatcccttactcttctagtcctaaggtgcattcctggttgtgtaattcacagattattatctccctggagctgagcctcatcatctctatcagaccagactgagaaggactcctttttcctttgtcccgccatcccagctcagtgcagaaggcttaagatgctttctccatcatttctaaagaacaacagacaaaaatagagatctggttaggtctgttcttgtggcgtgaagtgttaggatgagctgaacagccacaggggctagaaatgtcaagaatgcaatacgttagagcaggcatttagcattcctgtctctgatatctactattttattatgagtagttaccaaaacaaaacaaaacaaactgtaaaagcattattttgttataattaacaactgcacattggattaagtgtgattgagggtggagttcaccagcttgggaaaaaaaattaaccattaaagattccctgagtgttttgctttaaaaagagatagcccaattacttttctgtgtttcgttaagagtctactagtatatgaatcagtaagagcttctagggtaatataaaacacacacaaaaaagcaaatttgatgttagcagacaactttttaaaggtattcgtgtaactgaaaaaatcattttacgtacataggaatgaaattttatgtttacctagaaatatatgtgaaatccctccattattgcaagatctttttcatgtaaatatcaaaagaattagacagtctgcattgtttaaaaccaagatagctagtctttttaatctatgggcaacttgtaattacgaatagcagtagctgcctggaataatgtactgagagctgcgttggtctcagagaaaatgtgctgtgatccattggtgatctctgccagacagaagagggacatagtgtggctgcttgccatttaaatggccttgatgatctcatcataactctatatatctaatctcaccattaaatttgcatgcaaataaagtcattgtagcagaaacaggttttatgcatacatacaaatacatgtgtattttttgatatgttttgtctatttgtcacctatgaagaacatataaatattgtaaacagaaaaactctttttggatgttgcaaatgcaaagaagaaaaataagtaattctaattttcaaaggtcacccctgtaatcaccacccagattaaaaatagtaccagcagccaaaagtcacctttatgcccctttaagcccctgcccccacctactaaaaataatagtgatcctgattttgaaaatcacaaactttttaaatttcctgcttttgaattttatataaaaggaataatatagcatgtactcttttgtgtttggctgtttccctcacccccttgcaaaattatgtttgaaagatgatcccttgttgatgcggatatggttcattcattctcacttaagtataggtaattaagcaaacttttgtttgagatacaaattcagggtaaaaatcagattttctatttaaataataatttggtatatatgactatttgagcattttaaactgttgtcattttacaataattattttagtatgatttaatatccaaattctgttgcttagattcaccctcagtggacatttcttctgaagggccttcctagacttccccaattagaattaaaactctcttctctgtgctgtcatgaaaccttgtacatttctctaactcttgaaggattacaattattgtcttctgtctcacgtacctctcctgtgagcatgttttggagtagactgggtttgctcatctttgtagagcaatgaacccctgttcccagcaccatgcctgctccatcatgggcattcaacatctgtcctttgcatggaaagtagaacagtgagttcttccatattacaaagaatattacagtcaatttttatttttaattttcttttagtagatggcacttttcaggagattgtactgggtgagttgtagacacagtagttactctttatggcaagagttgtatagtatccgggaggatttttgcctcttccctgtggctttctttcacccttagtttgccaccaccactggcaattctaatctaggcacaccttccattgcctcctgtgtttcccattctaaaatatatacttccaagttttcctctatattttctgactgctcgaatgactcttctcgtgtcataaactagtaaagagtagtgcatatagaaatgctgataaatgtgttgcacatggttatcacccgactgacatgctgaccttctgactctatcaatgggtgatttttatatgaagccaagaaatctgttggtggtaagtactaagaccaccacttcaggctcactctaacctcattgtgtgcatcttgaaaccccacacagttgtcacatatgagcagattccacaggagggatgctgaaccaaagtgacaagcttgtcctggagccctaacacagggattgacccccgaccttcaaagtcagggaacaacttagggttggcttaccttcttgtattgtgaacttttccgattgtgaagccagcttttagctttaccacactcccagacttaaatatttggaatggcaagaaattaggcttaaaaaaaaagaaggaaattaaggcttaatccttaataatgaggaagtaatttgttttagtattgtacagaaacattttctagctacctgatcatttagtctagttctatagcttaaaatatatagtccttaaagaaaagttttatttctgtgggtctattagttacaaaagtaaaggtgcattttttattgctttatttaagtgtttattaagcttgttctgccacaggtaccctgctggctgttagagagacaatggtgaaatatacagcactcggcttcataaaatttatggtctagtgactttctgaagtatttctatagggcaggagacttctatttcaccttctactatatccttggaatagtttttactttcctggtaggagtgtgcatttatataagtgtttcagttgcttccagaaatccagtggtaaacaacataattttaaaacctccctacttgaatttggggtggagtaatataaaataaatctggaatatttgattttttagaccaaaatactttccctgggttagagagatattttcttttcttactggcctggaaatccatgccattttaataagagatatttttattctaggtaaattgtttacttaatcacctcctaacaaggctgtgtcagccaagttaaatatttaaatttatttttatttaaataaattttaaaaccaacagatttctttctcattttaatgaatttagcctttgagttttcaaagataaaatatacagagtagaacattttaatgtatctgtagagagggaacacaaaaagggcacatcaggaaaaaatagttggaaaaaagtgaattttatacaaaattaactcataaaatgaatataaggcattatttcacttattgccaaaatctgtctttacagataatcttcgggagacctttatttttataggccctagttaaaatattttttgaatgcttgaggctctatttcactaataagagaaataaactttttctttctataaataactgctactagcttgtttgtcagctctctaaataaactcattttactattactatgcttgagtgctgttatatattcctttgttactgtgcataatccctggctataactgcattaataagtaaggccattacatcaaatagggatctaacaaaaactttcgaatggactatcaaagaccagattcaatgcaggaaatcagaaggaaatggcatttatgtcctagtgtagttcagttaaaaggcctgcccttaaggattacaactgccataaaagggcaccatgcaagaatggaaaacctgtttacaacaaaatatcaaattattatctgactttcacaatgaaccacattattctatgactgccagtcatacatctggactactataccatttgtgtgcagttacagcagctccagttctatatggctagttttgaacttagtctgactttaaaacccatcccatttactatcctctgctttttttttttttttggtgtatattgtgggaaattccataaatgatttttataaactttagccagtaatcgggaaaaactgtaagattttgtttgtaagctttataaacgttacttataagattttaattgaattctaaattaatttctaatttgaacctctcccttctcttagctttatatgcttggtcatccctccttaagtaattagcttttttgaagctttgttttttttggtttttcactgtttctgttatattgacgatttgactttcttataaattgttagtaatttcctgaataaagtacagaagtttatctttcaaatttcccatggatcatttcttaatagtcaaacaattgtctaaatttccaatacacaaagaaaagttttagctaacttacttcaataagatggataatttgttcaaagtgccaaacacatttgctttcgtaattcatgccatttgtgtgttaagtgtataaaagagatagagaaagaatataggaaatgtaactacacatgcaatcttgggctttccaaaatgtttaaagtaccaaattcccttggtgccaattgctttaggcatttcatcttcactcagttgcatcctaaatatagcgtaggtgtgacataccctgtaaatttcaaattcacataaagaagtcccagccttcgaggcaagtcttaattgaatactaaataaaaaccttagtgtcttctgaaatgtttctgaataaatagttgctttacagtctttgatttctatgttcgttagtgtccaaattcagaatgggaaccaacttggggagaaaaagaaaaaaagactctcaggacaatctttttaaaggagtaacagataatctattttggctaagacagggtagattcaggtagtcagataatagaaaggggagtcccttgtgtatcaactgatgctggaatttgtgaaatcctataaagttttgtagaaaaaaatgttaaattcatggaaacttgtttggtcataatcctcacagtttctaatttagtataacatcctgaataaattcattcagaccgacggagagaagaaattattatttgcaatatgtgaatttctgactaataggagtaatagaaaataattggtcccttaggatatttctgattatatatgagaggcttggggagggactctgtgtaaccgttgcttttaacccttgtttttgatgggtaaatagaacattaatgctacatgaaagatacttactctggcatcctcaagagaaagtaggttcttttttttctcagttatccaagaaacttttaacaattctaaagaaagaaataaaaagcacttagttttcagaagcatgtttcagcttcttgcatcaggagtaggccagatggccatgttctgtatggctttataaatattcctttttgttccatgtaaaagttaatggctagttttaaaccttggtatcatttcgaagtcagaccttatgtgcttaacttcattcaaagtatttctattttgttaggctgtaggaaaacatagagctgagctattaaaattccagggcagtttggaattgccaacaatatgtactggagagatgggggtggattctgaagtcaaatgaatttggaactcatcttcttttacatgctgggtgattttggacaagggggaaaagctacccatagggtttctgtgaatgttaagtgaaataatacatggaaagtgcttgaagtaatggtagggacacagcaaaccaaaaaaaatgctagccagtttattattagaagggaaaaactcctattaatattttcttgtttatgtttgtgttttcatgttagtcttaaaacaagttactgtttgagaatgtgagaattttaaccatttacaaaatggtgtatgatatgacatgtatatgatctctcacaagtgaaatgataatggaaagtttactgaaaatgtcttaacagttctaggtaaaacttaatttttccttaatttgaaaattaataaaagtatgaattagatttaatctaaatttattattctgttaaagtcacatgaatgtggaaaaaaatcagtatcacttctaactaaatctggccttgaaacttctttgacatagtcttcttaaaatatatatatcttatattctaaattgtatattatttagaaatatgctatttctaaactgaaatgtctgatatttctaactgatatatatatctatatatgatatgatatatgattatatatatgttatctatatgatatataatatatgatatatatttctaactgatataacaatgtatctcagttcttagagatatgtaaattatattttaatagtagcctacaaagatgatacaagaagataagaaataaatatacttttatatataaaatagttcaacagcaagattcttatttagaataattttctacagttttatttagggtagtttctatacagaaaaaatacatattttatctcctttctgtgctaggctctggagatgcaatggtgcctccctcccttcctggagcttaccaagcaaaacaaattcactaaataaaattattcctaattgtgttttaagtccagtgaagagaacacaggagggaccgagttaaacagtgtgtttgtgtatgtctgtgtatgggtgtgtgtctgtgtctgtgtgtctctttgtggctgtgtgtcctagagatgtactttagttggagtggtcagggaagttgagaactgaaagaaccagtcaaacaaacattggggagaaggggattatagcaggtacaaaggtcttgaatatccagcagatatgaggagcagaaaggctatctttttcaatcacttaaaaaggaaaagaagtgaaagattgctgtcttaagaacttaaatttatatggcactcatgtatagatttccagtgaaaagttggacaacgtgaaatgatgggtttcctacctacaagtctccagtgtttgtctttgactggggtgttttctgtacatatctgacctgatttctgttgctagcctgtcttcccaggggccttggtgagccgaggtcagagagagtggacttcacctaggaaaaaaggaaaggcttctgacataaaagtgcccttgaaaatgttctgctgctgtaaatcccttctctttacacaaagtttaagaccctcccaagagtttgacttgctaaactacaagagcatttttattaggtgtaagatctcactttgactttaagtagcaagtgacacaccaggcaaccctcgctgaattctctcttgccataagtgcatagatttcagtgttctaatgcctctctgagctaaatttgcctctgatctgagttctaaatgtaattggatagtagatatatgtgagtaaaaaaaaattctaccaaatggttggaatagttttcccaaagaatgtaatattggccttcagctggtaataggatgtgcctgctggatgaatgacatggttgatgcaaaagacagatgtaagccgtggttccccaaactgcagtagggatgagcatgacagccacacatatcaaaggccaggtactgatattcttactggaaagactgctcaggatgtatgtggtgttctttttcctggccacccttaaggagtttatgaatgggttccatcagcttcaaacagcaaacacagtttggcctgtatgaactgaaacccatcacacatcattgccacgatcattttcctcatgtatgcaagttctcaagtatatttttggtcacaaaacagcaaaatcatgacaaaagcaacaataacaaccaaaagtaactaaatacgatttttatttagtatgaaatgtattgcattgtaattatttcaacatcataacatttattaaagatgtatgtatcactttattattctatgctcatcccccctctttatacaaaatggagcataatctgcacattcattgttctgcagtttgtattttgcacttgacagtatgttgatacaaagagaagctacttgtgttgctctggaagaactttattgagatataactcgtatgccatacttttcatctatagaggttatataatgtattgatttttagtatatttacgtagttgttagttaatatctaccattctttgaccataatgaataacagggttttctctgcacagatatgtccatttaagtaaagatgccaatgcagctaaatagaatcactcaaaaacaactccaaaatgagccagggagagtggagggaaggaaaaggaggaatgcatccaaacatagccctacgttccatgaacactcagtaacatcatcaaaacgtgatgcaattaaattttaccaggtttactgctgtcctgatgctttccaattttttttgacaacagttttgcctttttcaaattcaaatggtataattggggcttggtagttgatgtttatcttaattgaaacagattctcttcatccttttgctctgagactcccactttgaggctgaaaggtcattttaaatctgcagagcactcgagaagccacataatgaattcaaacaaattcatgcctattaaaaggaggcttctctttctcaacttccagagcttacatagaataaaccatttggtttttgtctgactttcttttaaaaggaagttattgtgcttcctttttaatgctctaactacagagaatggggaaatcctgttttcatttattcttatcagaaagaaagtgtattttgctcagtaattgcaataaaatactactggggttacagctactatacttgtcaacaaatttaagggatattctttagctgcattactttaaggatttcttgtctatcttttatctagcaacttcattttttaacatttactctatgtacttgtgtaaaggtgcaaaaaatatatgtacaaaaatgttctgctggagtttttgtaacagaacactggagaaagcctaaatgtcaatcggtatatggctgattgaacaactgatgcacaactataagacaatactgtgcatctatgaggaagacctctctagtatgacactatctccagatgacatttactattgtattatttttatactttgaaaagaagatatgcacactcccatgtatccattttcactagttttctttgtatatactcttagagtttatgtaagtgcaatgaaaacataaattctattctcttcctccctttttaaacaaaaagaagtataatctgcacattcattgttctgcagtttgtattttgcacttgacagtgtgtcaatacatagagaagcttcttgtgttgttctggaagacctttgttgagatataactcacataccctactcttcatcaatacagggtgtataatttcgtgatttttagtatattcacacacttttgcaaccgtcaccaaaatcaatgtagaacattttactaccactataagaaaccccttaccttatagttatcaccctccatctcccccattacctgctccatatcacctgcctcccttccaccccacagctctaggcaacggctaatctacgtttttttcctctataatttgcctactctgaatgtttcatataaatggaattatataatatgaggtcttttgtgacttgcttctttcacttagcataatgttttcaagtctcattcatgttgtagcatatatcagatttcattttttaggaccgaataatattccattatatgaatataccacattttgcttatttattcatcagttgatagacacttgcgttgtttcactttttggctattttgaaatgtgctgcaatgaacatttatgcaaaagattttgtgtgtgcatatattttcctttcttctgggtatattcctagtagtggaattgctgggacaaatggtagctctaagtttaaccttttggttattttccagtgtatctgcattctcatgtttcttacagcagaaagttattctcttgaatggctgcatcattattgatgtagtcaaggtgtatttttaagtggaaaagttaaggcacaatgttcccagttatggaaaaatatgctaagactgtacatacataaatatgtttcactcaaaagcatctttctgcgtatgcacttaaggtgatggtagaagttgctagctttgaggaagaggtggctacacgtttggaatctgaggtagaagggggctgagtactcaccattttaaacttggggaaattttactatgtgtgctaattaatttttcaattgaaaatttgattcattaatgtaaagaagaagaaatgtaaaaaataaaaaagaagaagaagaagaaatgtattttcctggactcctctgaccaatgttggtcaggccaggggcttcttgacctgtgctttgtttgagtcatccggcaccatgaggtgcttagtgctgtacaagcactcttcttgccatctgctctgcttgacatcatttttagttattaggacaaaaaattaatgactgcttttctatctttaagccaagacaccatttaaaaaacagacatttagctcttactctaaattagtgtttcttaaatgttttattcaaatcaatccacatcaaaagcaaaataggagggaaaactagggtagacatctgagtgaaccttgggattgagaaataggagggtggtatgtgaactaatcattaatggtattagcaaatagagctgggcagtctgtctgaagtgcttcccagttttttgtacattcttctccaagtatcatgtgttggtgactggaagagggagtctttactttccgcacagtttccatcatgtagctctggaagggctttgtgtttgttctcatctttgcttgagaatcagctgtcttattttgggcttttctattttttaagacaaaacctacctatagtggttatacatgaaacacaccagtagatttgatttctgcctttggttaaattagtttgccttattaaatgataggaaagaatcaaaattcgtttgccttatagatttgttcattcttatattcactcatgtattcattaagcatttatttattcaacactcctatgacatcactcctcactgagtgatgattccttctagggtgccatagagggcttgatttccagctggaggaagaataatttaatatcctttttaatgatcaaaattctaaccaaacccaattttgaaaaataacttgactttgcctaaaagtacattaagaaagatatagaaaagagattctatgaaaatgaaatttaataatgtaaaataatttggttttatcagaaattcataaacagactttacttagagttaaaagtccctttgagaggagtaaaatcattaatgaaaaaaatgcatacattttcttcaatcatcatctatatcccatcgtgataatgaggagtacgctgtgtgtagtgactgtgtttgcaggtggagggagtttgagtaatggaagtaataaagatgctcccagaacaagtaccgcatccaattagcttgccaattaacaatctattcctgaagtatttgtttatgaagatgattttaactagagagaagtcatattttattttgtttatatataaagatatgttaatcataaaatgtattcctttcaaacagttatacatttttcctttggcagcactattgtttattttaaaggaaaagacagtaactaatcacagcatttttaaagaaacaaatagagattatgctgctgtaaagccagcataaagccatttttccaaatgtcaacagagttaacaaagaattttatgttgtaaaaacctcacagttgcctagtttactccctcatcaaaaaaagagggggcaagattctttgacatttttatgtataatgtgactagagaatgtgacttcagtgatgatgatgatctaattgcaatgctaagaaccatggctgggctacgactgtgtgtgcacgttgttatgctggggagcaagggtacctaggaaagaaagcaataatgaaagtatcacttgggtatttgtttatttctggatcttattctatctgctccatattatcactttggcatttaaaatctagatgatggctgggtgggtgcagtagctcacacctataatcctaacactctgggaggccgaggtgggaggatcacttgagtccaggaatgtaagaccagcctgggcaacataggaagaccctgtctctacaaaaaaatatttttaaaaattctccaggcgtggttgcacacacctgtagtcccacctactcgagaggctgaggtgggaggattgcttgagactgggaggtcaaggctgcagtgagctgtgattgtgccactacactccagcctgggtgacagcaagaccccatctcggggaaaaaaaaaacccagatgatatggttaaccatattcagtcattattcagttattagaaaataagatttacaaggcatccatggaggggaaaacaattacacacctggttagttgggctgaggcttgcagagataaaatcacctgcacactgttgcagagccagtgctccaacctagacttccggacaccaaagcctatggccattaagcactctgctggactgtatcttggatagtttgctttatggggaacgtagtacaactttacaatacaactttaaaaataaagtatagcagagtagcagtttgtccacagtcaaatatgaaatatgtaaacatttcacaggttctttttttaatttttattttaggtttgggggtacatgtgaaggtttgttatatgggtagactcatgtcacaggggttggttgtacatattatttcatcacccgggtattaagcccaaagcctaatagttatcttttctgctcctctccttcttcccaccctccctgatcaagtagaccccaatgtctgttgtttccttctttgtgtgcctgagttctcatcatttagctcccacttataagtgagaacatgcagtatttggttttctgtttctgtgttaatttgctaaggataatagcctccaggtctatccatgttaaaagacatgatctcattcttttttatggctgcatggtattccttggtgtaaatttacctcattctctttgtctaatctgtgactgatgggtatctaggttgattccatgtcgttactattgttaatagtgctggaatgaacattcgtttgcctgtatctttatggtagaatgatttatattcctctgggaatatgcccagtaataggattgcatggtcaaacggtagttctgctcttagctctttgaggaattgccacactgctttccacaatggttgaactaatttacactcccaccaaaagtttgtaagtgttcccttttctctacaaccttgctagcatctgttattttttgtctttttaataatagccattatgactggtatgagatggtatcttgtggttttgatttgcatttctctaataatcagtgttattaagggttttttcatatgcttgttggccgcatgtatgtcttcttttgaaaagtgtctgttcatgtcttttgcccaccttttaatggggttgtttgttttcctcttctaaatttgtttaagttccttatagatgcaggatatttgacctttgccagatatatagtttgcaaatattttctcccattctgtaggttgtctgtttaactctgttgatagtttctttggctgtgcagaagcttttaagtttatttagatcccacttgtcaatttttgcttttattgtgattgcttttggtgtctttgtcatgaatctttgcctgctgctatgttcaggatgggattgcctaggtcatcttccagggtttctatagttttgggttttatatttaagtctttaatccatcttgaatttttttgtgtgtatggtgaaaggaaggggtccagcttcaatcttctgcatatgggtagccagttatcccagcaccatttattgaatagggagtgttttctccattgcttttctttagctttgtcgaagatcagatggtcctaggtgtgcagttttatttctgagctctctattctgatccattggtctatctggctgttcttgtaccagtaccatgctgttatggttactgtatccttgtattatagtttgaagttgggcaaggtgatgcctccagctttgttattttttattagaattgccttggctattcgggctctttttggttccatatgaattttaaaaagttttttctagttctgtatttcacagcttctaactacattctattgttggacatctttatattttatccaaataggaaaacattaatttaaaattcttgtcatataatctacaaaatatttatattcaaggcacaatgacccttacatattctttttttcttttctttctttctttttttttttttcgaggcaggatcttgctctgttacccaagctggagtgcagtagctcaatcacagctcattgcagctttgacctcccatgcttaagcgatactcccacctcaacctcatgagtagctgcaacaacaggcgtgccccaccactcctggcttgttttttttaattttttttgtttttttttttgtagagacagtgtctccctatgttgcccaagctggattcaaacaatctgcctgcctcagcctcccaaagtgcttggattacaggtatgaaccaccatgcccagcccttaaaatagtttttattataaaggcaatttatgtgcattctaggtttctttaaaaacctagcaagaggccaggcatggtggaatgccagaaatcccagcactttgggaggccaaagtgagaggactgcttgaagcctagaaatagagaccagcctggcaacaaagcaaggccctgtctctacaaaaaataaaaaataaaaattatttttttatggtgtgtccctgtagtaccagctctcaagaggctgaggtgggaggattgtgttcagggtgcagtgagccatgattgcaccactgcactccaccctgggtgatggaacaagactcttaaacatacacacacacatatacacacacacacaatacgacacacgtatagaaaaaataaaaatacaaatataaatttctcataacctcaacacactcccaaataatcactgctaattcttagttattttcttctattctttttccaagcaagtatgatactaatagcaattacctggattgtacagttttaatttctttttttaatttagcattttatcatgagcatttttccatatcacttaacattatttcaaacattacttatatggatacaaaatgtttcaccctaaaaagattttgtaacttatgtatttgccaattattggatattcaggctgtttctagcttttcccaattattaaaattatcagcaaggaacatctttgaactgaaacattggcttatctctgaatatttccttagtaaaataactatgtcaaagaatatgactattttaagactattaatatatgttgcaaaaaatacttctctaaaggttataccaggttacactccaagccacactgcttgagagttctcatcttactgtgctgctgcaggaaatgtttttcattaaaaaaaatctttatccacatattaggttaaagtggtatttcagtgttgttttacttaacacttttggactactggtgtgaataaaaatggttttaatatttttattagccatttatcttctgttaattttctgtttgtctcttcgcttattttctattggggttgcatagttttttactttttgcaagagttctttatgtattagatagatgaaccttctccagctcacatttattgtaattatatattccaatttttagtcccctttttacttttgttcatggtgttttatacagtcaaatttattgattttttttcttttgtaacttctttctttgctttaataatttgagggcttttatcttaagagtagataaatgtttagctacattttccgtatttgtgattttttaacctagctcttaatctgtttggaatttatcttaatataaggtagggatacaagtttattttttcccactatacgtctcaggaccatttgttacatgtgccctactttgcttattgctttgtgtcacagataaaattttatgtatcatctatcatgtgtagacacctcagatataaattacattttacaaataacatctcaatagaaacaagtagaaaaaaaagaactctggtgcaacccattgagagaaacatactacattacaactataacaatgatgtaactaaatttctatttgccttctaaacctttttattgcttgtagccatttgctaactcctgaagaaacttttaccttttcttgtcccagggagttgattatttaattacagtagcataagacaaaatgataaggattggaatccgcaatgagccctttcactgggatgaagcagaggctgatgggactgggtggtaggtgggtaaggtggcagatagatgcaagagcaggaaccactcaccaggcactaggaaaagctccatctagccaggcatattggcaatagtgtgccctgactagtctttgggggcaaaacataacagtctcctaaaaagtggctcagaacaggtaattcctagacatatgcccaggcgtgaacaggacaacttattgaggtatggaaataaaatcttatattttttcttatccgctcacaaattttctttttcttgtattttgtaaaatagataatattttgacataatagtgcaagaacataacttattgaaaataaatatacgtaatggaggtgcttgcacttttttttttttttttttttttttttttactaatagatacggtatccaataaaattggtaatcacttgtctggatcatgtgacttcaggaagctctatacaccagcttgcagttcatggatgggacaggaagagagtatcttaagcctatgttggaaggccaggtggactggagtctcagggacggaagataagcacagggaattaaagcagaagccagtagtaatcagagataagacgtatgttcaagttaactgcagcaggatggtgtggtgctgggctcctgaatctgtttctgcctaaagtcatatctgtaaagatcaaggaggaggagccagagcagcaggtgaggttcaagtgattaataacactggaaaggagaacaggttgcagaaactatggctcaggctacctattcagccattttcattttttgtaatgcaagtgcctattacataatcaagggtatccttagtaacatatgaagcctacattctatttccatttttaaaaagttcaccagtaaacaattgtacagcaaattttatcaatgtaaaaagccattgtactctatccagtcaaaccatattcacctctcctaaagtgcccattacggaggctctgggaaattgaagttgcccttaatcttgagttacaatgggcagggcctctttttttctctaaattttactcaataaatgcaggcttcctatgcattaaatggtgcccacaaacattgaaactactagctcacctcctgaaattcagcactttactatgtgtctttcaatgtaagagcattcactaatttaacaagcattacataacatgtgtcattaatgagttcagttagctaggccatggaatagatattcctgtaaatcaactcctttacagttactaactgacttagtttcatggcagaggcatttatttcaattagactgtggttcctgttgagataaaatgagatcaactatgtgacatgattttgaaaaccatattatattggtgcatgaatgtatatgtgtgtgggtgtaggtagtttacagacagaatgtgtaacataggcatgtggcttgtaactgaaacttttacaaaacctagttcattctcattctataaaagtgtgtacacacatgtgcatatacacacacacactgtgataatgtatctgtgtatttgagggttataaatatttagttgtagagttctgacaaagtagtaaaatagtctcacttcatctggataaagatcaccatctggaactataaaaattgcaatgattccaaattgttgaatagttggattgcatatttacttttcagtagtatgttggcatgcatgtagatccagccttcctttcaacaaagaacagtggtggaagattcccttaaatggttactctttcctcaataagagcaaccatataaaaattatagaactattagtcatcatagttgaaagtatcgcataagattaacagagtccccatctggtgatatgtttttacatcagatttattaagatcagagcgggttttaactagagcaatgacactgctattattaaataagagacggaaggcctaatacataattgtctatttctttctagacatttatgtgtttttattaggataatgaatacagaattatcaacatcatgatcatagtttttttggtttttaagtagtatctgtaatggcaagctcatttttattttataacctacccacacacagacctacagtgaagcaaaacagatgctgaaatatgtttgttgccattggctttgaagaaacctcagagaggtttgcctcagtattttaaaagcaaaatggttggtacctttctgaatagatgtcattgtgtccttcaaacaaagctgacactgtagaaaagaaatggattgccttgtctttttaccagtgaacatcttcacctgaacaaaactcatcaggaaaaataaaggattttcgaagtgtagttgttgtttaagcagatactagttattccatccttacaaatattttatatataatatatacatttatatataatatttatatgtatatttcatcacacaccaacatccacagacacacacacacacttgtttgactacttcctctattccttgaaacgcttttgagagacctgaaatatccttgtatggcaagaggggaatggaatcaagctgatttttccatttttacaatgtgcctgggattgtgctttgcagtttagtggcattttctgattcaacctcacagagccctgcatggtataatattgtctacatttaagatgagaaaagcaagatgtggagaggctaggaaatcttcccaaaggcacgaagctcctggcagaaccaggatttgaggccaagtatcaaggttacagtacagatagacatacatacactcaattataagtaaagtttttatgaggctgggtttgacagcaacatgataagtagaagtttttgatttggtaagatttttcgaaaactcagagagtttattgccaaatttatttttctcctagaaacatttttgttgttgttgttgctggcatggacagttataaaaataaattagaagtaaacagataacagtttcctggctgccttcatgtctgtgagcctaacacggctcccagaaggaaaaaatatgcctcaaggaggcttatatgatattgcttatttagggaacctttgaccacttatttacaatatccagttacagctgtgctactttcctttttgggcaaaagcacatattcgcttgaccattattttggaggaagctgatattgcctgtcacttccaacatgtccttgtgtaccctagctcataattgcagcatttaagcttggagctcccctaacaacacaattattgccaaatttaccatcgttgggaacattggtgaggcctgcttcagaggcctctttgtcagcaagaagcatgttgcagatatgcttcaccttgcatcataaatgcatttctaaaagtagtttcctattgaattattttgtaataacatgtttttctaactacaaaataaacacatgttcattgtggacaaattgggaacttcagaaaattcccaataaatattccaatatttattaatattttataaaatacacataacctgtcattgcagcttccagggatagccatcattaaaacgtgttggtttatttcctgaataaacctttaaagcatatacacacataccccacaaacatgctcacacacacacatatatatatatatatacatttttatggtcatatatatcctattatgtgccagatgaaatcaggtcggtctctctatacacacacacacacacacacacacacacacacacacacacacagacacacacacatacatacatatatctatacatatatatgtatatatgtaaatgtacatacatgtatgtgtatatatgtgtatatatgtatatatatatgtgtatacatatgtgtgtacacgtatacatatatgtgtgtatatagagagagagacctacctgatattcatctggcacataataggatatatatgaccattaaaatgtatgtatatgtatatatatatatgtgtgtgtatacatatattatttccaaattttgaaaatttttatttattattttttgagatgaagtcgccctatcgcccaggctggagtgcagtggcacaatcttggctcactgaaacctacgtctcctgggttcaagtgattcttgtacctcagcctcctgagtagctgggattttagttttgccccaccacacccaactaatttttgaatttttagtggagacagggtgtcaccatgttgcccagggtggtcttgaactcctgaagtgctgggattacaagcatgagccaacatgcccagcctgtatatatatataattttttattctgcattcttcgcttgacatttttaagaagtattttctcgtgtcatttaggattctagaaaaatctgatattctaatggtgacataggaatccattttacatgtaataaaatgatttattcaatatttagccattctttcattgttgggcattttaaattttcctcttttttctttattgtagtggttcactaagcatctttgtagaagaaatgttaatctgtatctctggttaattactttggcaaaatttttggaaatgctattactgggtcaaagagtttaaatggtgtctaaacttgtcaagacatactaaatatacttccagatagtttttacaacaaattttaagcctacatataaaaaaacagttccggtggctcacgcctgtaattccagcactttgggaggctgaggcaggcagatcacctgaggtcaggagttcgagaccagcctggccaatatggagaaaccccatctctactaaaaatacaaaaatcagctgggcatggcggtgggcacctgtaatcccagctactcaggagactgaggcaggagaatcacttgaacctgggaagcagaggttgcagtgagccaagatcactccactgcactccagcctgggcaacaagagagaaactccgtctcaaaaaaaaaaaaaaaaaaaaaaaaaaaaggttattttaagaaattgtatagtgaattctcttttttaaaaaagggaaaacatttatatatttattaatatttaaacctgcagttttataaaattttgtctagtccgacactcttgttttacaaatgggaaattgaggccccagttccatatgagagacaaatacaaaaatctgccttctaaagctggtcaaaagcagttatatctctatgatcaattcagaagttgagtcctctgttgaaatgatttcaatagttgaggtgattttactgtttctctttaatgttgtgatatattttctctcttatacgactctatagtaaaaacgagaatcattttactcaatctggttcatgtagcagtatcaggctgtgaaattcatactgctcagacactggttctccaactgtgatgtacgtaagaaatactgtgcctgctgtctcttaaatgtagagtcctgatcttcatccctaagaccctgattcatttgctttagataacactgagagctaatcatttttagcaagcatcccaggtaattctaaggccatattgtgagaaaagccagtataacgatggagaattcttatgttgatgctctgacactggctctacatctgtccataatttatttaactcctctctgcctcagtttccttatctataaaggaggaaaggaaatgccagtctcttccacctgggattcttgtgagattaaatgaaataagccatgcaaatgatttaacacagtctacagcacacagtaaatactcaataaatgtgaactcattatcgttactgttgtcattggtattcatattgatatcattattcctgcattggaaaatgtaaatgtacaattttaagtgattagcattgctggtggattattgattgcaatttgtcctgctgtctcttctgacattgctaaatttcatttacttaaatatttcccttatttttctcttgttcccacccatgcaccccagtggagttgaaattgagttgagatcaaatgcagcaggtgttgctcagagaatttggtaagactagttgaaaaaagatcagtgaaactttatcaaaaatagaatagtgattctcctggtcacctgcttagagaacccattaagaagtgtgaggttctccaggccaccatagagctataatctgcaccttgtatcagccatagcaggtatttgcacagtaaatttcccctcacctagtttattcataggtctgatcatagcacactacagactcaaactcctgggctcaagtgatcctccaatgtcagcttcttgagtagctgggactacatgtgtgggccaccatgcctgaccatggagttcttaaaaatggatattgacatacatatatagaaaattcattcaataaatagttatcactttcctatacctggtgtgagaattatgctagatattggaaatacagaaatgaatatattaatattaaagtcacttaactaagcttttccctgtgataatctttctgaaacaaagcaaaatgatacagaattctttaagtactattcaatttgtggctatttcctcctaaagatcagtgtatctgaacttgctggctgctagatattttagtcatttcaaaatgtactgatttggctaaagaatctactttgaccaaaataggataccttaaaatacaacatcagcaaaatatgtgtaaaatccccagagaaaagccctcttaaatgcctacttatttcaagtcaaatttagttaaactacataacttagtcccctgagtgtcagtggaatttctcccagagctgtgacttcgtcaagtaaagttaccctctctcttgacctttggaaagagatggcatttgttgatagttttgtgtgtgtccttaagctgggcgcttaacaaatattctctctaacaaatattctctcattaaaacctgaaacagccttttcttacacctagaactttgtaaagaatatgtcaggaataggacaatcaccttttaaggctcagacagccaagaagctgttttctttttcagtcaagtgtagagagcatccatgactgccaagttctcagccatggctggtacaggcgggtgcagtaggaggcacagttgccactcctcagaaagaacagggacatggctggacccattgtcctacttgctcagggccaggcagggtagcagacctagttgttgaatgcccttttattgatagttatttaacttcaataggatcttgtttttatggtaggcagatggtccttaattggtttgaactttgtcctcttttcatagcagaaattcttaatctgctgcccacaaataagctttggagatctgtaactcccttaaaataacaaaaatgtacaaagcatttagtaagtgtcatacagtgtgctgagcacttcacatgctttatctcctttaaatctcataaagactcatcacataggtactgttttcattcccatttttaaaatgaaatttaaagagactaaatgacttgaagaaggtcacaaaactaaatagcagtagggtcattattttaggccaggttatctaactccaaagcccttagcttaatcactaggctatactgaactttatggaattacatccaaaagggatgtgtgtgtgtgtgtgtgtgtgtgtgtgtttgtgaatttttccgaagactcacatttccaaagatttataagtcatgtcgttctcaaaggggtctctggtctccaaaatttgaaactctttgcaacagggtggctatgttttagaatgacataaacagatacaatgttctccagagtccagagcagggtctaaacctattgggatactatacttgtgttatcaactgaaccacttggttagttcactaggaagatctgcaggtcttgagctgagcttagtgttttacagacatgtgccattcattcatcacctacaccactcatcaaatatctgaagaactatgaaggctgaaggaaaataagtgggtgagcacaggtgcaaataaataataaatttggagcattctatttcgtgttatttcttgctaaaactggcatattaccccaaacatcaattgcaatatgctattcaacaagagtttttaactagtttataataggaaaattgctcttttttaaaaaccagggttaaagtcacatcctttctctcctctgacaaagtcactgtcacataaaataatggtcctagagtcaaaataataacagaactttgttctgatggagactgtaaatataccaatactcccattaaaaatataggtgggctgcctgaactgagaaggttgtgtcatggctgttagttttaataactggaaggcttgacagagataattgcgttagtgcttcactggcctcaagatgcatgcaatgagtaaaattaagaccatcttattaaaataccaaagcattgtataggaaactcccatgtattcaaaggggaaagaagaaaaaggaatttcatatttacggagcatgtactattttcaaaactctgttctaggtgctttcacattcattaactcattttaatatgtgagtgctttgtaatcctttttgagtgttgcaggctcagagagggtaagaagctttgcttaaggtcccctagctggcaagtaacagaacctattcaaattcagatctgatttcaaagtgcatgtagtttttgccacagtacgatgcttggggagctaaatggcatttgggaacctagagttaaagcatcagtattttttactaaggggccattggatcctagagaggcaacgaattataatggataaaaatacaaatttcaggcaagttacttctcttagcaccattgctttatccggcatagtaataaaaatcaaatgagacaatggatatgaaatgctaaaaatagtacattctctgttgttattatctattgtgattattgtgttacccttggaaaaaggcctgtagaatagtggcagctgggtcccctggacagtgaactaccaacctaaaaactgtctgggcaggcttgcctttgggagttcttgtatatcagctctaattctgtccaggaattcagaggcagagagcagggttgaggagaatttcacaggtggtaagatctccggtgaggaggcatttcagcaacgtgatcagtgttgccaaagctatgaaagatgttgaagaacacactttctacctgagatatcaactaaagtttgaagcttcaggagaaggcatagttctatcaacagacagcagtacagcaccaatagttaaaccctatatggtagatttaaatgctgagccttcaaaatcatttgcctgttttactttagctccagcaaagggatagagaaacccttcttctgtcatccctctcccatgtttgctgttgcttaagcagtatttattttggtaacaagaatacctggccttgccacttaatctccaccattccaaagaaaacctttctgagatcatcttaacgttgtctctaggcaataaatatctctggtttctagttattcccaaggacactgacctcacatttcttactgtcttaaagtcaaaagtacctttgtccttaactcacaccaatatgtatgagactaggatatgagagagattgttacatcttgcttgatgttttgacattataggtagtgtaggttttgttattacagtttgacttttgaaatgcgtatgagatttctcaggtgaaatagagcctttgatgtggtactcaaaagggataactatgactcagaggaaccatttctaaaagatggcactctttctccttccagttctttctgttcaatagtagggctggggaaaggcagaggcagtttttgttatttcaaatgacagcatcaaagatagtaatccacggtgctcaacaaaagtcgaatgaccttttttccttctccattcataaatacataagagctgatgcttcattatgtttaaatacaaaatgcacactcctactttgttttcctatatgtgagttctcatgtattcttcaaatgctcatctaattactgttacctactattccaaatgcaaatgacaaggtcccagtttactgttgatcctatattacaagagtcatcaattttggttgagaaacacaaaggacaaatatctcattattgtgctaaccatgcctattattagttttgtgcccccataacataagtaatagccccaaatacatggcacttatcacacaccaggcataattctaaatggcatgttctccatgttatggaagaagagactgaggcatggagagagtgagtaacttggccaaactcacaaggctacaaaggcagagaatcaggttttgaactcagggctgcctagaccctgtgttcttaactatcatcatatagtgtctctcttactgtttctcactgaagatgagagaggattaaaatctcaggaataaatgtaacctccacaggtaggcttatgcataaaattcagatgcaatgaataacaaaatgactgcctcccacaaaattaagaagcaaacatataatgaggacttactctgtgcacacactggtgaggacacgttacacatttcatatcactgagttcacacacacacacacacacacacacacacacacacacacctatatgagggcagtatgatttccccatgtgataaagaaggaaagggaagctcagacagattagatatattgtctgacattgttcagatagcaagaagcagattcaagatgcaagcatagaccagagaccattatttgagaccatgaggccttttctcaccagttattcattcacttaatattaatcacttaatatgcatttgctgagcacctgtcgatgtcttgtaaatcagtgcaggaaaatcataagatttgaaatcacagcatctaggttcatatctcagcttcatcattaaccagcaaaccagtaaacctccctgtttgcagtttcattatcaataaaatgggttgacaaaaaatttatttaacagaaatgttatgaaatgcaaataaaataatggatgtaaagaaattggcaaatggtcaagcaaaacatgaatgttaattttatgatgattaaagtaaatggtatggagacccccaacctcaaatagctgggaaggggtagttgataaggggagaaatgtgtttaaagccagttgctttattattttaaccctgagataatgctttattgacagtgtgaataagatgtttggaattgtggaaggaagaactggaggtcatattacacatttcttactacatgttgagctttgaaaagtgagaatgatttcatgaggcagaaattggttgggtctaaaacttcattatctgtaacacatactccagagagtgagaacagtatgaccagaagtatctttggaggggctagagacaagatttgaagggaattaggacaagattttaaagtaacctaagtgccgtgataaagaatccacttttataggcaaaagtagttattcaaggaagtaaaataattacattttctagccactgcaagctatctctttttccttccttttcttccttcattccttcttcctttcttcctgcctttctttccttccttccttctctccctctctccttttttcccttctttctccatcccgtttaaccacacacaaaatcccaacagcagcgtagaaagtggtgttgaagagctgggcatgtgggcagggacaccaccaaggaaggtggtgtaatatagcctggtgacgacagctttggctcttctcaccactcccgctcccgagtaagcacagcatagaggaatatgagctgagttcagtgctgtccagttggaattgggaatgttaaagctagaaggtcagcaagtccggtgttctcaacctgacaacacatcaaatagctatgacagccttttgaaaatagagattcctggatccagcttcagctttaccgactcagagtatccaaaaggaggcctaagaatctgtatttttaaaagcctctccaaagtgatatgtagcagtaattgaaaaggacaatctctttacttcattgatgaaatagctaagtcccagagaagtcaagaggcttgccaaaatcacaacgaggtagtagcggggtcagaactcaaactcaaggctcccaattctcaacccagtagtattgcccagcatcagttcttatctttgcgttataaatacattcctgcccatcaacagtggattgcaaaagcagggaggaagagagggtggcaagggtcaaaaaatagctatcaggtcctatgttctctacttgggtgacaagataattagaagcccaaacctcagcttcctgcaatatagccatgtaacaaaactgtgcatggacccctggatctaaaatttaaaaatcaataaataatacaaaagaaatacattcatatttttctgaaatattcttcagaatatcaagtgggaatccctttgttttgcaaagctggtctgatatgtttaagtaaatttaaccagatagttgttttctgtatctccctctaagtattaacaaacatttaccatacactataaagcattacaatattgttaggatgattaacaagagtaccaaaatgaaggactcttgctaaaatccttttccagctttttcattctactatttacagacatgtaagcacatccattcatttcagcaaaatgtaacattccacacaaaggttttgaacattgtgctcggctagagaatatttctagtgagtgctcataagagacattaaaataagcatttgtctttcattcaagctttatgaaggattaaaagtaatccaattgttcaatccttcatttaaatctttagtccaaagaacagaagatttgggattgagtcgtaatccagccatttaaatctatgagactctaggcacatcattgccctccttcctgagcctcagatttttcttcagcaaataaggataaaaatctacactcccaatcccatcacttattgcccagggtcactgtgtgaattccactgaacaatgcctgtgaaggtgctcagaaacaacctgcttgtgagggcataagaagcacaggaggaaaaggcctttgggaataattcttttgtctcacccaggacaggttatctgaccatcaggggcacagatggaactctttttggacatggcaagtgggtaaagcacccaaggtgccctgagagatttttttcatgtggtctgaagggccacatactttcgtgggattagtggcatatgtggtatggaaactcataattacattgcaaatttaaaggacagctctgtaggaagaagccaagagcagaataagcatagatgtggtttggattttatttttcctcttgtcaaatttaacttaagttctgaattctataaaaaaagaaaaagagtggtgaaacagtcatattttaagatttttaaaagtcttaaagacatggaaaaagcaaagacgatacctacactgcttatttaaaaaaaaactcgatttgagtttcatgaagtactggcatttgctcactctgtaattctcaaagactattttcaaaatttggtcaaattaaatttcaaaggtcagcaaagtatataatcatgtttgggttcttttttcccccaagtttaaaaaactgacatctatcctttttttaggctatctgaatgtatgaaaaaagagtagaagttattttacagcatatatttttctgtaaaagtaactacatttaacattaaattatttaccagtggtattcattttatataagcaggctggagatggaggttctatttacatatttccactgtcatggtacagtatagtactaagtattttacaggccagcaatcaaaagaattacaattgctactaggaaacactaaatctgaggattctgtcatgactatgtatagctggttagaaaaatctttgctgaattgaatggctttctcattacagatggccttgtttacactgtacttagagttctgtgtgccattttggactcctcattaaaaaagcataagtcattttttaaaagaggataagtgggaaataaaatgggagccaagattatatcgaataaattctacaaaaaaagaaaaaagaaagacaaaatacacataattgaatatcataatctatctagaaaatagatgaagtggcacaaaaatggatgaatatattcaaatgtttgagaaatattacttcataaaaatgagagaaattttaatggctggagaagtaaaacttgattttttatttgagaacatagttaatgtcaaaacaaagaaagtcagcaatgaacattgcttctcaacttgaggtgattagagaagaggtcaaatgcctttagaaaacagctgtgcatttatcttggctgtggacctggcaagtcaacaggatttatgaatagcctcaccatgaatttggtcatcctgaggggaaggaaaaccccaaattaattttggagcagaagatcagtgtaactactaccatccttacgtcttctcaatgagcttcattattcctcccagagtggctagagtaggtagttgatgagcatttgtggaatggataggtatctcttttctatgacctactctatcaccctcaggatctattaatcctttgagtttgatctctaaggtggcaatgaaatatttcttacaccagaaatacactgaaactcagagaaagagggctcaaatttgaggagagtgctatactggcaagaggatgccccaggtaatatcctttccttcttctagagaggaacatttggctctagaaaggcatttagcctatgagttcagaacaggaatggtcttaggcatctgattcaacctacgacattgccagtctgaaccaactcatcctgatcccactgcaaatgagctaggcaacagtgaagagtggttctagtctgggtttggataaattgtgaaatatttctagaatttttctatagactctgaaccatttccccagaagtgtgcacattcaaaatgtcattttgcttcagaataacattttgaataaggcaagcctaatttttgttttttaacagaattttaaaataattaattcacaatatttgtacataggataatgggatattttgttacataaataggatgtataatgaccgagacaaattatttagggtatccagcaccttgggcatttatcatttctatgtagtggaataatttcaatttctttcttctggctattttgaaatatatgatacattattcttaactataatctccctattctgctatcacacattgtaacttatttcttctatccagctgtatgtttgcatacgttagccaacctctcttcattcccctcctcctggtagctatcattctattaccttcatgatatcaactttttttagcacccacttatgagtgagaacatgccatatttgtgtttctatgcctggcttatttcacttaacattcaggtcaattcatgttgctgcaaatggcaggattttgctctttttatgactgcatagtattccattgtatgtgtatgtgtgtgtgtatatatatatatatatgtattttctctatcggtttgtttgttggtggatactttggttgattccatatcttagctattgtagatagtactgcaataaacataggggttcaggtatccctttgatatacagatttcctttcctttcctttagataaacacccagtagggggattgctggattgtataatagttctacttttagttttctgggaaatctctatgctgttttccataatggccatattaatttatattcccaccaactaagaattcccttttctccacttcctcaccagcatctattttttttttttttggtcttttaataatagccattctaaggtaagatacctcactgtggttttgatttatagttccctgatgattagtaatgttgagtactttttacatacctgttggtcattttacatcttcttttgagaaatgtcttcatgtcctttgtccactttttgatgggattatttgggtttggtttggttttgtttttgctgttaacttgagttcttggcatattctggatattagtccgttgtcagatatatattttgcaaatattttctcccatttaacatgttgtcttttcactctgttgattattttctttgctatgtagagatttttggttttaatatagtcccatttgcctgtttttgtttttgttgcaatgctttgacgtcttaagggaagcctatttcgatctggtacttctgaaatctcattggctcaagtgaagcacgggtgtaaatcctgagtgtttgttaatctcggttctgtgtgtcttctgtaatccagagacaaattcatgtgtcaggttcacacttgagctgatcctctgtaactttgctgattgttgttaagacagaacagaaccagactggctttcactttacacaacaatcacaactgtgtgtaatgattatagacttattctctaacatctcttaagcacttaggtaatgagaaatgtcataatgaaaatatctgttaaccgaggaagatcaagggaacaaaacaaaaaacctaaatgaagtgtgaaggtggtagaagtaaagacatagatggtttcacttgggccagagatagattgaatgtgagacatttgaaagtctaatgtactttcagtacgtactttccagtttactttgatggaacgcactgtgttgaatgttattgtgctgacaaataagcccccaaattaaatgacttaaaaaataaactcattcttcatcaagtagcgttctaggatggtgtttaggaggatgtggcagctctccttgctctcagtcacggaccaggattctcccaccttctgtttctaccatccttcacgcatcagcatctttagcatccagctggcagaaaaagaacatcaagataggcatgtgggaggagctatgagccagtcctgaaagtggcatgcaatatttctgctcacatctagtcacttggccaaatctaattgcaagggaacgagaacttcttttatgcccaggaacaggcagagaatggaatatggcagacaacaagcagaatttcctatactcacagtcctgattattgacttctatgctttcccaaggtcattttgtcttcagccagattccatttcaaggaaacatgaaaatgtttcttcactctataaaatcattgttgaagtagatcctgctacctctgtggtagcccatccaacatcttaaaacttttaaaagataatttgtaaccatacataattcacccaatataagaaatcatgagagaaagctaatctcagtgtacttattatacaatgagacacataatgagacatatctttttttattctccactatatattttaaaagaattgaagaggcaagtgattgtttatggccatcgtaagataatattcttatcattgctttgcccagtaagattgaaaaaattgtctgtaattcaggccacacaaccctctgaagcccttcgccattcattcaagccccattaaggcagaaaacccatctgtttggattgttgaggttggaaactgaataatatcacttctccaaaatagatttaatagtagggctggtgaatggtttcctgacctgtttgatgcagagtgcaaacccagaggaaaaacatggtatatgagttttcgtatccattagtctaaaagaatcagaattcggttatattttaaaggcaattatagtagaactattacttttttgttttctgttataatcttacctagacttatttaacatacttaacacataatattttaaggctaagtatttctacaaaggatttatcattcaatcattcttatttagtcaataaaatcttttggagattaatttttagtaagcctaaatacccaaatagccaggaatgtgattgaggatcacatttttaaaacccatccctcaaaaagaaaattgtaatatcttgagagacaggtatggtttgaagatcacccctcttcaaagtgagttcaatatctgacctaatggaatcactccccattccccaggactaggtgacactcactgatctgggaaaaataaacacgtgcaactaacaagagaaattttgagaattatgagtaagctttgaaaatttgggtactgaaaatagagagggagggagagagggaggtgatagggagggagggaaagaataaaaaggaatgaagaaaaaactaataacaatttatctcttaagaaaatagaaggtgcagctgggtacggtggctcacgcctataatcccagcactttgggaggccgaggcaggcggatcgcctgaggtcgggagttcgagaccagcctgaccaacatggagaaaccccaaatacaaaattagccaggcatggtggcgcctgcctgtaatcccagctactcgggggcctgaggcaggagaatcacttgaacgcgggaggcggaggttgcagtgagccgagatcgcaccattgcactccagcctgcacaacaagagcaaaactccatctcagaaaacacataattaattaagtaatgatataaggtgctaaatttttattttcacccatccagtttcttttcttattctttcctgatatgtaattacctcagatgcagatctgaggtgaaactaatgaagatcaagctaagagcttctcactggcctggttccctttcaagttgtaagaagtggtactagcagctgcacgtagttttaggttttgtaaaattcaaaaaactaagatttttttgtattatttttctgaaagcagacccttataattgtataatcttcgtgtaccacaaaaccttgatcccacccctgattgcatggctgactgctgttcaaacagaaggatattcaaaataacccccgttaaaatgccttcttagagatgttccagattatttcttcaaatgtgctaatcaatctcattaacctatttctttaaataagtgaccaactcctagctaaattaaaaaatagttatgaagtttatttaaagtagaactacacagataaccatggtaaatgataaccggtatagaaaaagtaccgctgcgtctaaagatacccatgtattcacgatacaaatatttattgagcaactcgtacgtgtgaggcactgttgtacctgctgggggacacattaacgaacaaagtagatttttaaaaaaaaatctctgcacttgtggagcttatattctaatggggtgagtaagatgataaaataagtaaaaaacaaagttcatcagaagctgttaaatgcgatggagaaaaattaagagtaaggaaggttttttgtttgtttgttcaaaaaaaaaaaaggttaggaggttaggggtgccagttttaaataggccagtatgggaatatctcatgaaggtaacattgagctgatatctctagaaagaatatgccaggcaaagagaactgcaaatccaaaggccctggggagggagtatgcacagtgcttcaaggacagctagggaccaagaggctgagcagagtgaacaagagggagagatgtaggtaaagatgagattagagaggcaccagggaccaggtcactgagggccttaaaccattgggagaacgtagtattttctctgaataaaataggacaccattatgggataatgagtaggaacttgccgagaatgggcttacattttaggaggatcgctctgtctgcaatataaagaataaatgtgggtgggtggctggagaagtagcagggcacatcattaaaatatcaatgtttcaaagtcggcttattaaatcaattttacttgctctatgtcatagaaacaataaataaagacagaaacaccccgcaacactaccttgggtatttttctttgcttgcttgttttttttttttgttgttgttgttaatattttaacttttattttaggtttagggttacatgtgcaggtttgttatataggtaaacttgtgaccccgggggtttggtatacatattattttgtcacccaggtgctaagcatagtacctgacagttagtattttttttctgatcctcttctctcctcccaccctccatcctcaagttggccccagtgtctattgttcctctctttctgtctgtgtgttctcattatttggttaccacttataagtgaaaacatgcagtatttggttttcttttcctgcattagtttgctaaaaataatagcctgtagctccatccatgttcctacaaagaacatgatctcattcctttttatggctgcatagttttccatggtatatatgtaccagatttttctttatccaatctatcattcatggacatttagtttgattccatgtctttgtgattgtgaatagggctgtaattaacacatgcatgcacgtatctttatggtagaatgatttatattccttttggtatataccctgtagtttgattgctgagttgaatggtagttctgtttttagttctttcaggaatcaccacactgctttccacaatggttgaactattaataatttacattctaaccagtagtatataagcgtttccttttctctgcaaccttgccagcatctgttattttttgactttttagtaatagccattctgactggtatgaaatggtatctcactgtggttttgatttgtatttctttaatgattagtgatattgagcattttttcatacacttattggccatatgtatgccttcttttgaaaaatgttcatgtcctttgcccactttttaatggggcggtttggtttttgcttgaatgttcgtttaatttcgttgtagattctgggtattagacttttgtcaggtaatacaatttacaaacattttctcccattctgtaggttatctgtttactctctgttaatagttgtgtttttttttcctgtgcagaagctctttagtttaattaagttccatttgtcaatttttgcttttgttgcaattgcttttggcatttttatcatgaaatctttgccagttcctatgttcaaagtggtatttatttggttatcttccagggtttttatacctttagcttttacatttaggtctttaatccatcttgagccccactttgttaacaagacgctattcctctttggactttagcttgatgaagccacattttgagaaagagtgcattttggaaatatagcatcttagaagtgatcttagaaagtgaaagattggtagtaacctgctgtgagcagtacaaggaaaataaaactgagttattcctgtgggactacagctgactctcaggtccagcctggcctggagagcatgtgcttttctgctcttccctccatactcttagttagtggtcagcacatgataataggatgtaagggaagaaataaatctctacttgttttattctcaatcacagtgacacctgcatgaaattgccagagaaattaaggcctcccaatgactaccaaaaaaaaagacactttccgcttcccattgtcagcacgtattctgattgaatgtatatgtttactacttgaagttctcatgatttctaggtaattactgcaaatatggacctcatactgctactgcaggctttgcctcaagagtccaaataccatggcctcatgttagggccatttgagatcctttttgaaaaagttgctttattgtgctaaaaacaaagacacataatatgagatctaccctcttacattttaagtgtatagtacattattattagctgttagcacaatgttgtacagcatatctctagaatttattcatcttgcatgattaaatgatacacattgaacaacaactctccatttctccctccacccaggcccagcaaccaccatgctacttcctgcttctatgagttcaactactttaaatccctcatataagagggatcatgcaatatttatctttctgtgactgacttatttcacttggcataatgtcctcaaaattcatccatgttgtagcatatgacaggatatccttcttttaaggctaaataatattccattgtatgtatataccacattttttaatccattcgttcattgatggatatttagattgtttccacatcttggtattgtgaatatacataaatgaatatgggaatataaatatctctttgacatgctgatctcaattttttggataaatacccagaagttgaattggtagatcatatggtagttctgtttttaattttttgaggaacttccatactgttttttatagtagtggcatcactttacagtcccaccatcagtacataaggattccaatttctgtatgtccttgccaacaggtttttttttttaataatggccatcctaacaggagtgaagcaatatctcattgtggttttcctttgcatttccttaatgattagtgaggttgagcatcttttcatatccctgtttgccattttttgtcttctttggagaaacgtccatttctttcattgggtttttttaattttgaggggtttcaattgggttttgggggggttttgctattgagttgtaggagctcctatgtattgtagatattaataccatatcagatatatggtttgcaaatgttttctcctaatctgtaggttgtattttcactgtgttttctcccttgctgtgcagaaacattttattttgatgtagtcccacttgcctatttttgctttttttgcttatgctttgatgctgctgtggattaggaaacttaatattgttaaaatgtccacaatgtccaatgtaatctccatcaaaatcccaatggtattttttatagaaatagaaaagcagtcttcataagaaaccacaaaaggctgaatagtcaaaacaatcttgaaaaagaacaaaatatctggagatctcacacttcctgatttcaaaacatattactaagtgacagtaatcaaaacaatgtggtactggcataaagacagacataaaaccaatagaacagaatagagccaagaaataaactcacacatacacagtcaactgatctttgacaaggatgtccagaatatacaatgaagaaaagtcttgaatggtattggaaaatggtattggggaaactagatattcacatgcaaaagaatgaaactaaacctttatcttaaatcatacacaaaaaatccactcaagacttaattataacacctgaagctgtaaacctagaagaaaatttagggggaaaatttcatggcattggtcttggcaataatttgagatgctttcttagagagagtttcagttaagaaaatttttcttaacagtcattaaaaagtaatgtataaacttcaagtaaaacaatttttggttggggctttctggttgccttagtcaactcaggccgcataacaaagtaccctagactggtggcctaaacagaaatgttctcacaattctggatgctgagaagtccaagaccaagattggctgatttggttcctgttgagggctctcttcctacatacagatggctgctttctcactctgtcctcacatggtgaagagagaatgctcttgtgtctctctctgttcttataagaacaccagcactattggattagggcctcatccatatggcctcgtttaacatatgaattctaggggaaacaagatagatttaacctcaacctcaacctcatgtaaccattggtgattaaggcttcaacatatgaattataggggaaacaagattcagtccataacactggcctaataaatacttttcagaaaaattggccttttatcatatcattgtgtcaaaagtgtgctaagcaagtccagcttatcctctttcatttatagtccagacatcaaactcatgctatcatttccatcttgaatctctttattgccctgtgttacttgggagtgtcactgacaagccagaaacatatgttgtatatttccagtaccacctaatgttttactcataagtaagcatatacccttcatctttgtaccagtgtgtgtgtgtgtgtgtgtgtgtgtgtgtgtgtgtatgtgtgtgtgtatgacaggatctcactgtgttacccagactggagcgcagtggcatgatttagactcactgaagcctcagcctcctgggctcaagtgattctcctgcctcagcaccacaggcttgtgccatcatcgtgcctgacttttttttttttttttttttttttttgtagaaacagggtttcatcatgttgcccaggctggtcttgaactcctgagctcaagcaatccactccccttagcctcccaaagttctgggattacaagtgtgagccaccatgcccagccctgggcttttgtttataaaaatcatctgtgaaaacaaagggtaaaacgtgtctgttaaatatcttaactctgtgcaaatatatatattatacaagctaacatgtgtagtataatttagctgtgtaatcttgtaaagtagctaaatatcatgccttctccgggtatcctacttaaatttaatatgcagttttatgattgattgggaaagattgccatctgtgcatatcactgtaaaatgctagtttctacagtctcatctccatagataatcagagaaaagtaaatattaaaatggtgaattttgcaaatcattattttgtttacttcagagaagctatttgacctgcagggaaattttcaatagagaagtatcagtggcattgattagaaacgagcttcataaccttgtgatattgataacaatgggtaaaatatttagtattataaagagggaaaaatgtatgtagtcatccagttacagttactctccccttaagctcaagggtaagcctcccctccccttgagggcaaagcatcaaaatgagttccaatgtgttggctaacagcatgagctacaatacacaggggagagtggagtacaggaatataaacatcagtataattgtgacctgaggtccccaagctacaccctgtgtctggagacctgaggtctgaaggactgtttctgctcattatattcagctggagccccacctaggttgttgggacctccaagccttccacacttcctggtaggaaattattctttctcctcagtgagtaatatctagaaaaaaatcagcagtctccaccctccccagatgttatcacactggaattatggagttgggtggagacataaaagcagctgaaacttttagagcaatctggctccagcatctgtcacctcattgattgcaagggctgattcaggtgatttggccctcagttctcttcctctttcatctctccctttaggttcttcccaaagccatgtgttcaaataaagttaaagagaatgacctagatgaagatctccctgggagaaaaagagtaataaaaatgaaaaacaatagctgctaaataatgggagtgtactagctgccaggcaatgtggtgaatgctttccaaacattttctcttctaatccttataatggccctagagctaggtattgtaattatctttatcagcagtgaaagcctagaaaatacagcaacttgccctagagcacccaaataggaagtggctgaaccaagatttcaaatttaacctgtgttttctaactcttaaataaacatcttaacaggaacatttttggtaggtcaatattttctatgtgccattgttcttactatgtagtgaaaaaggcagctttcagatggtcctggcttcagtgatggctcccaggattcccagcgacattcagcaagatcttccctgtgagtggccttcatagatgcttcggtaatggaggctgctattgatagaggttccttagcagctgctccactgaggccctcattgccccacccactttgggcttcatactgggggtcagtgctaagtataaggtcctgatggctaggatagatgaggaaagctatttactcagcacagtagcaggactctggctcaggagagggcccatatcatggtcaaaaataaattgggaaaagtttaaactagggaagcagtgtctagcaaaaggccaaaaagatgagaaatgaccttcagcagacaaacaattacaaggtcagtagacacaaagtatgcgagcagttgagagcgtggatgaaaggtagattggaactgtattaccatccagtaattccactgaaatggaacagtgtggagaactgggagtaattagttcattcgtcagtttgtccgacttctctttgtttcttgtagggggctggttccatagaaaaggatgggtctgtggagtaaatggtcatgagtagtgctagccacacacattctttaacacttctgaatgcagcaggccagctggtcattactgttactgccccctcatgggagaccaaatatagctatatcattcctcctccaaaactgccttctggcaaaagttatctcttttaagaattgtgtgcattcttaaattgcattaagggaagcaaacatatggaacaagaaagcacctcacttagttccatttgctaagcccttttgcagacccactgacccttccttaattccaaatgaaatctcaaatgctataaagaaacccgccaaatgggttacagcaaagacttttttacaccctactgttatgttcagaattggaaaaagctggggatttggcaaattccaaaatgttgggtcatatgaaaacttttttttttgagacagagtctcgctctgtcgcccaagctggagtgcagtgacgtaatcatggctcacttcagcctcgacctccttagttcaggtgatcctcctgcctccacctctggggtagctgggactacagataagcaccaccacacccaggtaattttaaaattttttgtaaagatggtgtttcaccatgttgcccaggctggccctgaactcctgggctcaagcagttcaccagccttggcttcctaaagtgctgggattataggcatgagccaccacacccagccccatacgaaaatttagtctcagaattagcctttgcatgcgtcacctgtaagttaatcagaatgttactttcaaaagttccctgcaggtgaggaagctaaaaggtattcttgtatttttttaaatgaaacttcataatagaggtgtaaacagagtccattctccccagccttagaatcagacagcttgagtttaaaacccacttatgagcttgagcatactactgaacatagagtcacttgtctatgcctcagagtccccatggtcgaatggaaaatacagtgcctacttcaaagtgttattgtgaggattaaatgagataatatatgcaaagcacagcgcctggaacatggaaagtgctccagaagttttattgttattaacattattattattgccaccatcatcattaaacttggtaatttttactctccccaatcctttagttactttttcaaacttctagttttttgcttgggctccatctaattggctgtgagtcaaaagagaattcaccacatccaagtgttttctaaagaatgtctttggaaaattcacaactgatcattttgataccagcatctaaggttagggctaccttatccttcatcaccttcttgttttattcataacaccacgatgtggactattgataaaattatgtttcaaagataactagcttatttgaagccatctataatttcagcccaaactgactaattaggctaactttcagaaagttaagtaagtgtctaattctcagttaacttactacctactgagtaaaaatgtgctgccttttaaaatccacaactaacctccctactcaaggcaaaccccctagttctaatatttgaagtatttaatgaacaagcctttttgggggtcctcttgtagttaaaacatttatttttctcctttttttttttaactctgttttttgtctttctttttttttttttttttttttttttgagacagagtcatgctctgtcgcctagattggagtgcagtgacacgatcagtcactgtaaccttgaactcctggtctgaagcgatcctcccacgtgtgcctctaaagtgtcgggattacaggcatgagctactgtgctcagcctctactctgttttctaccttttatttgttgcaaaagcaacatgtttattttaacaaatactggtcttcctcatcttactcccctgagatttcaatgttaaaagttgatttgtgtgtttccacgtaagtctttataacaagcttctgctgacactccttggcccagctttccataaacacatccatccctacctattaggttgaactgtacaaaattgccatttttataggtccccactattctttaataccaagcctcaaatttagccagacactaaatgtcctgttttatatacacgccttattcattccttcttggttttgtttttgtggcttcacttttgctggatggcctccacccccaaccccagctctactctggctggacattttttaactctccttcaaaggtgtacatcctgcaacttcttaaattccctttacattcattgtctacatcacatagtctgattgcctatataatacaatttcgtgttttagtatttatatgctatttaatacagatgccacctgttttgctgcttttattttctctggttgcttgatgttctattaccttaactagactttagtgctttctagaaaaggacaatgtgtagtatatctgtacttattcaagtgctgatctaaggacataggatgtaatgtaaaagtttattcaatgactatttcaaaatacaaagtctctctttgtataaagtcattcactaatactgacattggctgatacttcagactggagattctcggtaatattactttttcttgataattaattttgattataagaggatttaatatcatggaaataaattatgcaaatgaactcagaccctaggttcacttcccagaacaaaccgtattctgagaatacttgtggtgccaaaatttagagtgaaaccccagactattaatgatgctcaagttactttactccaacacaataagtactcagtgatttgttacggaaattcaattaagtcttctcaagtattttttttcttttcttttttttttttaattatactttaagttttagggtacatgtgcacattgtgcaggttagatacatatgtatacatgtgccatgctggtgcactgcacccactaactcgtcatctagcattaggtatatctcccagtgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcatttaagaaaaagtccaataaaatatcagtcactatttttagatcttcattctcaatgtttgtaaagctaatactaatattagattaatgtaattttatcaatattgataattacttagtatacattgtgaactttgttttttggatgtcatttaaagggttattttcatgagttcctaagaaataatttaggcctttaaggttatttaacccttcagtagaaaatagtttccttgtttaagaaaatgatctccatctagtggacaaatttttatattacagtatacaaagaaaaatattaaagcccctagaatatctcatatcaagcacttcctgacctattaataaatgttttggttttagtgctaatattatggcttaaaagttgtaagatttaaaaatatcataactatctaaatgacttaaggtatttagcaatatttgtttcaaaacttatagtggagtgttaagacttgcttgatttaattggaaaaattataattaaagaaaaaattactgatttatacaaatttggtgtttactcagttgaactgaaaaaaactaaaccaaaactcacacttctgtatctcttacatttctgttcatgcacaggaaggagggggtattttcttttttaaagtgtagcaataagaatatcttgatattaaagggaaataaacataaacatttctacaggcattcacattactaggtcctcctcatgctgaaaagctgccatgactatcttcttagaagagaaatctactttgccaaacccccactatttagaagtttttaatgtcttccagttgtgtactaaataccttcaaaaaccttcttaaatactactcttcatgaaaacttctcagatatcccagcctgagttagtcattcatcctttatttttgtatcttaatgcactcatattaagtgcttaataaatgcctatttaagcatatccaaggagagtttgccaaagatccctaatgtatgtctattgaatgattagagaccatcctccccttccagccttcctgggaattgacaaggtttcacatacatatgtgcctatcctattctggtgaaacagatgtcccctgtttgggtgccacatatatttgtggtttatataatcatgcagtagagctggaaggactttaggaacaatcgatgattcaatgcagttagctcagtgactggtcaattaacttttctaggacctggtatcctcgtctgtaaagtgagtctgttcgacttgacaatctctcattgtccttcctgaaccaaataaatatatctataaagagacacaattctaagaaaattttaagttggaaaaacatatttacagctgctcaagataatgagttttccctcttctgtttatttgatggattatttcggagccactgttatttgatcacagattcaaaagtgatccatgaaacatcttccaatcttagagtcataactctatttattaatgactccgataaagaaaataaaggaatgttttaaaatgagctagttaatagtttgaataaagattctaatggggaaaatattaatgacagcaaaacttgaattcacatgtttatttattctttcaacaagtttttctttaaaaccacacacctgctgggctatcataagctatcaccctcctctcctaagaacacatgaaagttgactttattttaatactggttgatgtttcactagaaaggttctttgtggaaagtttatctagattataaggactatgacgttaagaactgtgtgtgtagattttttcccagctctaaaatatgtattgctgagcacagtgccttttattcatttaatcatttactcaagacacttgggcacagttttcaatgtgccaagaatacgctgagtctccatttgtagagagctcacaatctaggaatggagaccgggtgaaaaacattttcaattcattgtaaattctgtcattagggagtgggaaagtgtcttgggagcgtagagaaagggcctttcataaagctctgatgtaccagggtagcctttcaggtgcaggctaagtctcaaggatgagtgacagttaggcaggggaaaggggatttgattatttaggggagcaggaggtgaggtggtgatggcctgtgagaaggagatagtgcctcaatatgagttgagcaagaagtacccaatagctgaggatggcaagttgaggctgggggcaactaattgcaattgagagcagatggttagactggcagtctggcaaagaaattttgacttcatcctgagagcaatggtaagttactgaagggttttaaactgaagaatgacactggaaaatggattcaagacactaatataaaggttgttataataatataggtgaaatttgatggagacctgaatttaaaatattggtagtagggatggaaggaagtgggtacaatagaaattaatgcttggatggatgttatagggtaggagtgtggagggagaagcccaggtttgggagaacagcattaggcacaaaatgggtatttgttgaatcgaattcaaatatttgatgaattactgtgtatttgttattttccgaaaggaattttgtacttagaagattatgttttgcagagtgtttcccttttaactgaagtagagtttggaaaaacctgtatcttgtatctggtcagttaacaacagtatccaggagaacaagaatgtgaagtcaatgtgtttttcttttatgtatttcaatattatcatatttttatggcagaaattagctgtaattttcattcctgctaattccactgtcagttcctcagctgacgctaaatgctttttgaaaatatgaacatgtgaatgttcacagcaacataattccttctccttcctttacagttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatgtaagtacaagggcaggcaaagagagagaaaaccgagtaaatttatatctagagctgatgacataataaaactaatgacttttgttcaactgtatcactctcctccaatgtagaaagaatatgaataaaattatacaagctagaaatgaatggtagatttaacctgagtgcactgtcactcttgattaacacacacacacacacacacacacacacacacacacgcatgtatttattttcccagaaaatactttataggaaaactgagaattaaatttttaatggaaactaacacttaaatcattagcttatatttatgtagagcctgagttttagctacctaactacatggatattttctaatattttgaaaagctttcaactccattgaaaagtcctgtgataatagactgtatagcattttgaatatatttcaattaatgtatgtacagatgttagcactggtttgccagatcatttaagaaatctttgtgggactttgccaaaattaaaccaacttttaaggatcatgagaggcaagcacagaaaacattagacagacttgaatatcatttaagatatagtacagcttgaaaaacaatgaaaactgacaagcaggtttgcagatcctgtaccatcactagctcattttctcagtgcatttcattcttgtggtagtgtgcatgtttttctacataggtctttattctcactcaatacctatactatcattcgtggcacatctgcctctgtatagaatcgatcttcatctttctctcttggtctatacatttgtccaataacattcaccatcttttcatgacacccatctcaaaaactcataacaggctgcaatttatcttataagaattagtctgtatggaacccctgagtgtctagtgttattcttgccattctaacagagcatcagttgtattgcaataggtctacatggggttctagaaatgaaattatatttcactcatttttacaaactatggttgctattttagcagttgtattattgacgtctacccttcttcatctctaaacaactttctattcctagtggccctatttttacattatttttatctcacttccttagatttgaaattcatgacacttacttattcattcacacataatgagaatgcttcttgagcaaatatggtgtatttaaagctctgaatctgtggagcagtgaggtctggcattttagaccattgtaataaaatatggtgagcacaatccttgaggcatttatcatgtactgcaggaacagagagaggagatggagagttttccacccaagggaaagatacagaaaataccgggctaagggaacaacatttactaaatgtgaggcatggaaaattatggctgaactaaggaatgacaatctgcttgatgtgaatagcgaaacctggcaagagagaagaaaatttcaaatacagtctatgggacctgagagccacagaggtttttagctgagttttggcatgatcatattcttgtttttattgcatcttgattactctattgttgaatgattgcatagcgaagtcactacagggaagtatttcatgtcgaaattcacagaagtaaggcaggctaaatatgatgaagacctaagtcaagggagtgatggcagtggagcaaagagctggtttagatgcaagaggcttatagaatggttgtgtgtgtgtgtgtgtgtgtgtgtgtgtgtgtgtgtgtgtgtgtgaagtatgtatgtatgttgggggacagccagtggagaaggagaatcaaagagagtgctgatttttgtccatgaatgagtacgtacatggtgatgtacgtacatggtgatgaggaacaaagggcagagagtagaaaacatgacagataacaggtgatgaattggtttgtacatgataaggctaggggaaacaagacaacagttaaagtactgggacagcaaacagaaataacagtccagaggaccaggagaaatagaacagttaccttctataattactaggtttttgaatgacagttgagtggtgcgttgtattcaggtaatagcattaggagcccctgggttaaggagtgaattgaaagtggaaatgtgagcaaatgcaggcatctctttaaaaggctgatgggtggagtaggaagaaagaactaaggctgcctgacagagaattaggttcaagcggaatttttttgaattcaggttacttgagctgagggaaggctccaggagatagaaagagactaaaaattcaaggggaaagagggtttaaagatggagctgtagttgctgacaaaaacatgatcatgagccaaagtaaggaggctatccttggaaaagtagtaaataccagaactgtattctttaggaaggacaaagaagacctgccttggcaacatagtgagaccttgtccttactaaaaatccaaaaaaatagctgggcatggtggcacatgcctttagtcccagctactctggagaggtaggaggattggttgagcctgggagttcagggttgcagtgagctacgatcatgccactgcagtccagcctgggtgacagaggaagacaagactgtgtctggaaaaaaagaaaaaaagaagaaggaggagaaggagaagaataagagagaagagaagaaggagaaggagaagaagagtaaaagaagggaaatgtaaatttagagatggaggagtaaaatgttaagagatattagccatgagttctctaaacattttactcctccatctccagatgaatgaatgtaaaagtagaaggtacagccatcaatagccagaggagagagggatggggcagcttgagaagaaagggaaaggcttaaaaaagccactatgcagatcaaaaaagggaacagggtaaaggtgagtagaatactgaccagccccatagataacaataaacaatgttaaataggcgaatgacagaattgaaagtcatctaatgcaacttcatcaaaggtgagtcaggcttggtattgacaaaagaaagaggaaaactcacagtgagttagtggagtccatttatgtagttatgtgttctacctttttaaattgtagtaaactgagtttgggatagattgtttctttcatacattctactccagttagtaaatattaaatatatacatatattttatgaaaagcttatagcatttcatatttaaatatgaaatgcttttatttcaaaatcaaacttgcaaggatacctcattttgctgtgtgcctcaagagttctttatctgatcagactcaggtaggaatgatgagtttaatcagaccatgagtcaacactatattttgctgaaaagtaatgtgttgatatgtttagctttccattctccttggatatttacattggagcagtaagatattcctttgataccaactcctagaaagcattctttctaccaaggagattaagtttctgtggaaggaaaaggaaatagaataaataataactatttcaacatttaatctgacacgacacatatcttccaccataaaggactgtgccttctcttaatttgaattctcatatggccatgtgtaaactttaattttctcaccttacctagttcacaataatgctatgaagactgtctgatgtgtataattcaactgcgctttatagagaatgatgttatatatttaattacttgatgatttcttattaatagttctagttaagctttcctattgagaaattttcttagaaatttcaaatacaaacagtacctaatgaggataggtacctaatgaagggtatttaaaatgaaggtttgtggttatctatttaattgaactgttttggaaaacctttaaatactctttaagtttaaatataactatttactctattgggaaagtgagaagaaggaagataatcccttcctagtagataggatatcgtcatcttatcctctataaatagaaaccaatgaaatagctgaagaacaaaacagataaagatggtagtaataataatcataacatacatggtgtgtgtatatcatcaactttcccaagtattttcacaccagctatcttatttgatatactcacagtccttttgatagggacattgttatgccattttacaggttagaaagccaaagtccaatgagcttaatcttttgaaaaaaaagcaagcattttgattatttctaggagcacataatttgataatgccattgtaaacaaagtactttatactactacagcaaaaactgctgagaaacagaagtaattgttgaccaaattcattaaaccaatgaaatacatagcagtatcaaaatttgattaagaataaaataaaagctcaaggaggtacaaagtaaatatgcagccaactcttagagaatgtatacaagtatatagcactaggctaaattcagaatctaaaaaattagctcatataaggcagaagagaagttcctgaccacttctgctcagagaccgtcacacaatttgttaaatatagatgatgcagtagcaacttaattcttaagaaaagtaagaaaaagaaaaatgttaagtattagcatgagtctagtaaataaatacatgaaaataaacttgcattaccattaatagtaaaaattttttataacagtagaaacaactagataacaaaaggctggttgcccaagtggtgtcatgaagtaacatgaagaaaattacagcgtaaatagacaatatttttgtcatcttaatatttcagcatctgaataacaatcacttctgtgttttcacatcatccagtaatatagtatctgtatttggaaacacataaagttatgatacattgcaaagattaagaggagaattagcaatgacaagataagtagaattaagtcacaaaactatgaatttattaagtataagttacctgtcaaactacttaagttttaagaaatactcaattcacctggataactaatcctctattccccatcctctgttaaattaacaccaacacatagaatgcaaagatgatccaatcggctcttcactcacattcatatacattgcttctacacacagaatatggggtggggtgaatgcattcagagggccagtgacgaggaagtgagtagatttgatataccataaaaagctggggcatatttgggaatctagctaagttatccccaggcactatacagatatctcagacctcactgatcaggccttcggggtgccccattggggcattttctcagctagtagataatactctccctacctcccatgtcaaactactgtcctttctttagcaattaacaagtccctcaccacttcttgggcctctaatgtgtgttttcagtcacagccactcctctctactacttttgcctgctaagtataagagtagtattgcttccagtcctgagtttgaaaaaggaagaagaattccctttatgtcaatttgtatcttttattccagattattaatcttccctggtctcactaggaagaatataaataaaaagacacgttgcattacaaaggttctaattctcactggatctacatgaaaagtttgtagtcatctcttacctagattgcaagataatattacactaatgaacatttcaaaagcatatcaatttgttatcttgaaagctttcttccattaaccacagaaagaaagctaccatggccaaatcatctcttccccagttctgggtttttcccagctggggaggtatcctcacccctcaccctgtggtgtaggagtgatgggactagggccagagttctcaaaatgtgtcctgaggcaacagagggaatgtacatgggtgcaagcgttattttaaatgttcaagaaaaacacgaaaacatctgtcaaccacctggaaaactaatagcttggaatagttcccagtttccaattaagaccatgatattcctttctgtgacaccatatctttgcaaaattgggttttcagcagttgctggataaaaatgaagtgctgagcagaaatcaatgtgcaacaaaaaataagggaggcaatgtccaatctcattccaaaatgagaaattgacatagtgctcagtgggtgctaaattgttagaacaaaaccttattaagttatttggacttaactatttaataattggaactattatttattttggccaatgtgttgctgttattaaaaaattgagatattaagggcaccatgtactgagaaagtctgaaaatatttggattagttgtttattcatatctgaagaattagagctaaatcaggctaggcatggtggctcacatctgtaatcctggcaatttgggaggccaaggcaggcagatggcttgagctgaggagtttgagaccaacttgggcaacatggtgaaaccctgtctctacaaaaaatacaaaaatttgctgggcatggtggtgggcgcctgtagtctcagctacttgggaggctgaagcaggaggatcacttgaacccaggatgttgaggttgtagtgagccacgattgagccactgcactccagcctggatgacagagtgagaccctgcctcaagacaaaaaaaaatgattaaagataaatcagatctctatgtgagactatttgagagaattttgttaggagttaaaaaaataacagtttccaagctgtgaagtatctgatgtgctctagagtagagaatttatctttttcttaattctgttaggatcccaggtagccaaaatctttttttataaaatgtgatattattttggtaatgacctagatagaccaggctttttcttccattgctgtgtgctggccactgttactagtattattcggagtgttgatgcaggcattaatactagctattaaatctcaagaagtttattggcaaaatatgctaaggtcatctgctactagaatacctttttactatctttttgtttaaaaattctgctttatttggtgccatttattcaatcacttaagtcattttatttctgatttaaaaaaatgggagtttcatgaattgtaaaataagtcttataaattagctaaacaagtttcttcaatccttgaactgggggatttaaaatattagctgaataggcattttatattcctaatctcatactttcaaaaaaatcataaaaatgaaatcctgatgtttagacattttaaatggtaatgtttttaatgccacagtataaaaataaagcattgattttaatgcactgctacagtgagatggtgccagcacctctaagtatcattgccagtgctctaacctttaaaataacgaattaattgagttatatgtagtaatatatcttggctattactgccaaagtaatagatatatactgaagtcttaggagagatagagggataaatgttagttataaaaagttgttaaagcagagggaaaaagaagtgaaaactgaccaaacatatacgtaattcattgtttctatgacaagcctgctgcaattcgaactctaggactttgtgctaatatttagcataccattttattttctagatttcctttatactcactatgttcctcagtatttgcactcacttcttttgtttgtttgttttgagatagagtctcactctgttgcgcaggttggagtgcagtggcacaatctcagctcactgcatcctccgcctcccaggttcaagcgattctcctgcctcagcctcctgagtagctgggattacaggtacctgccaccgtgcctggctgattgtgtttttttttttacttttagtagagatggggtttcaccatgttgaccaggctgggctcgaactcctgacctcaagtgatcctcccaccttggcctcccaaagtgctgggattacagactgaactcacttttaaatcttttaaatgtgaaaaaaaaaactctaaaaatcatgtgagtttttctcactcctgtataaaagagaaagagtgtgaaggtgaattatttaaacttataaataatgattatataattatgcttatacatcagatttaatacatttcaaaggataatatctactttctttaaaaaaaaatgcagggagaagtggtagtttaataacaagagcaattattccacaatcctatgagacactgaattcctgccagaagaaagtaaactcagaattggcctcagtcaaggaagattagcctatttttcagtgcataccaaaagaatgcaatctctaagagcacattatgtgtgaaataaactaaaataaggaaagtttgaagaacattttgaaagaaaaaaactagtccagtaacctggatagtgctctcaatgaaacacggcccctagatgaaggacccatagttgaaaattactgattcttcctgcctcttgaaattccaagaggcaaatggccattacaggagagatattggttcacccagttgtggatattgtacctagaggtacactagtgtactctcactttatctcaaccctcttccctctgtatattaaagaagactaaaatcaaaaccatgctccagtgtattgtaaaatagaaatattttgaactttaatttttttttcttttcttttgagacagagtctcactctattattgcccaggctggagtgcagcagtgtaatcacagctcactgcagccttgagctcttgggctcaagtgattctcccacctcagtctccctagtagcccaaacacaggggtatgctaccacacccggctaattttttttaatttttagcagaaatgaggtcttgctatgttgcccaggttggtctcgaattcctgagctcaagcaatactcctgctttggcttcccaaagtgctgaaattacaggcaagagccactatgcacagcctgaactttaagtcttgacggtggggcatatggtggcaggctgggaagaagaagaaagttgacttctattggagatgaccaatacgtgttttccaccacattctaaataaaggtgtgtattaattgatgtgcatttttgaatgagtatcactgttttactcgtttggaaaataacagtagcacctactccatgccagggtatcatttgaagacaccatagatccatgaaagtaagacaaaaaaattgtttggagcatgcattcttgtctttatttaatttttaaaaattcttgatacaaaaggagatgtttccagccaacactgagattcccatatgaatacttgttttcacttacacatcaatcattttaaatatttacttttgcttgtcagtcttagcttcttaatgaattgttctcaatgtctcctttactgttttctgagccatataaggaaaaacagtcacactgctggaacatttatgtgatgtgtttcttgagataagatattccagggagtattactaaatcatactgtctaagcccttgcaatatgaatcatctaaagatgtgcttctataaataaacagaaagaaagcatcaagcagacccatggtttttctttagaaaaccaagtaaggaatatcaaccactgggctttgctttcagattcctggtaatctgtggtatgattcacaccaggttcacagaggaaacaaccccaattattccgtctgcctactgcagcatctcctaggctttgtgtccacctacggttaattgccttgagactttatggtttttcctaaccttgggtcaagaaaaatttgctgacattgaatactggaaagttgtatctaaacatatataatgtgtcaattcctgcaaccctctctttaagacgcagggaacttcagagcagaaagaaaaagaataactgctcacccctcaacaaatgtggaaggttgtgatgtgacaagaaatcatttcaccagttcagtaaatgatgttgtctcccaataaatgtcatgaatgatcccaagtccaaaattttttaactcattgtttcactcccaagggagaacaaagctacatgcagatctcatatttccatgtttcaaaattcattttttctttggtgcttacagaacttcaaattgaatttgttataaccaccaagatcagttttgtttttgtggattggtgtgtgtgtgtgtgtgtgtgtgtgtgtgtgtgtgtgtgtgtgtgtttagctagtggatagcatattagacagcaccgagagtcttgcagaatattctgttgcagaaatagaatgttgcagaaatattctattggacagtgctgttctagagtctaaaacatttacttctatgtgccttcagaatagtctaaatccatttgagcatacagaaagcggcatggtaaaaacaaaacagtatttgaaggcctgggctcaaatccagctacactgaacatttccatgccttgggattttatgacccagtaaaatttctgggacactgacctagggttactaactccttattttgccaggtaaagaacattaacaaggaattacccatcaatatatatgttaattttattttttaaagacattttcacttcagtgaaaaagaaagagcataatctcagaataaaagaattttccaaaggaatacgtatagtttaaaaaaaaaatctcactgcatggtccatgtacactctgactttgacaaggaccactgagcattctgttgggcaagtaccagatcttagagtggcatttggaaaccactgagttctgtcagcttgtcaagggcatgactgccaatgagtaacttaagttgtcagggcctagttccttatgttagaatgggaatatgagcatccatttaatgcagagttgtcaggattaaattcagcatgttggtagaacaccgtgtctggtgcctagtaggcattcataaaacacattgctctcctctctgtttgatcaagggcttccttttaatctattgaatcttttcaccacatgcagacctttaaaattgttgcactagttgaccaaaaatcttttccctaggatcccattctggtgaaaaaccaaaagggcagggccactggcattaagaacaagcctgccaataagataaactgtgaaagaagatcccgttcctagaacacaaagtgagagcacttgtgaatccctgcccatgtactcaactctttcgctgtctttcttccctccatggaagtcagactctcagctttgtactcaaaccttctggtgataatttgggacatcagccgtcctagaaaagtctctctattgtattggtttttattaaacaaaataacctaatatgcttagtgaatatgtctacacacatgtgctaaacatttgtttaattatttaacttggaaaattttggtgtatcatttctaacagagatagtctttgtgccatcatataactaacaaatttgaaggcattcattggcatcatgtattttctctaatgagtcctaaattgttttctcatgacaaataaagagattccattttagactagattattttttgcttatgttgcgtaaacttcagtcccatctgctttatcatcagtgcctgtcctccacaagtgatatgagcacacatgagccaaaaattaaggatttttggttgaaagattttttttttttttttggtcaaagatggggccgggctctaattcttgttttaaatttatttttcatcaacaaataacaaattatatgcatttattatatacaaggtaatattttgatatatgtatacattgtggaatgattaaatcaagcaattaacaggtccatcacctaacaatttatcattttttgtgatgagtacatttaaaatctactctcagcaattttcaggtatactatgcatgattattaattatagtcaccagcctgtacagtagatctcttgaaattgtttctccttctaactgaaactttgtaccctttcaccaacatctcccattccacatcctcccattctcccccaggccctgctccagtccctgggaacaactgttctactctctgcttctataagtttgattttgtttttagattccacatatgtgtgagatcacatggtatttatctttcttgcctggcttatttcactaagcataatgtattctaggaacatccatattgtcataaatggaaggatatcccctttttaagcctgagtaggattctagtgtgtgtgtgtgtgtgtgtatataacattttctttattcatctgttgttagacacttaagttgattccatattttggctattgtgattaatgctgcaccaaacatgggagtgcaggtatctctttgacatactgatttcattttctttggatatatacccagaagtagaattgctggatcatatggtagttttatccttaattttttgaagacccttcatactgttttccatagtgactgtactagtttacattcccaccaacagtgtaaaaaggcttccttttctccatgtcttcaccaacatttgttacctttttttgattaaaaaaaaactattataggtgtcaggtgatatctcatcatggttttaatttgcatttcacttaagattagtgatgttgagcacttttacatatacctgttgacctttttttgtaggtcttgttttgattttaatttttttgtagagaaggtgtctcacgatgttgcccaagctggtttcaaactcctgggcttaagctatcctgctacctcagcctcctaaggtgctgggattacaggtgtaagccactgtgtcaggccattgttttgagaaagacctattcaggttttttgcccattttaaaatcaggttatttgtttttttgccattgagttgtttcttaattcttaaaatattaataagatgtgagcaaacagtttaaatttcagaaaactaaatatctttgaaggtcactgtactagtctgttctcatgctgctgataaagacatatctgagactgggcaatttacaaaaggaagaggtttaactggactcagagttccacgtggctggggaggcctcacaatcatggtggaaggcgaggaggagcaattcacatcttatgtggatggcaacaggcaaagagagagagcttgagcaggggacctcctctttttaaaaaattagatctcataagactcattcactactatgagaacaacgcaggaaagaccagaccccctaattcagtcatctcccaccaggctcctctcaggacatgtggaagttgtcggagttaaaattcaagatgagaaccccatctcaaaaaaaaaaaattctaacctgctttaagaaataaaaatagtggtttgcacttgtaattccaactgcttgggaggctgaagtgagaggatcacttgagtccaggagcttgaggctgcagtcagctgtgaattgtgccactgcactctagcctgggcaacagagtgagaccccacatctctttaaaattttttcaaaatatttaaaatgatcaaaacgggcgaggcgctgtggatcatgcctgtaatcccagcactttgggaggccgaggcaggtggatcacgacgtcaggagatcgagaccatcctggctaacacggtgaaatcctgtctctactaaaaatacaaaaaaattagctgggcatggtggcaggcgcctgtagtcccagctactccagaggctgaggcaggagaatggcgtgaacccgggaggcggagcttgcagtgagccgagattgcagccactgcattccagcctgggcgacagagtgagactccatctcagaaaaaaaaaaaaaaaaaaaaatgatcaaaacaccagaaaagctgcatacacagatatacaaacaggtggcctgagtttggcgttgaaaagtttcaatttggaagatgttacctcacacaatactagacagctttaatgttactcatatattaatttacattttctttgattctcagtaaaaggttgctggacattcttgccaaattgaaagttttggtagttgtgatttttaatacaagtttttgtgttaaatagattattttaattctaagtggcaatagcttcaaagaggaaaagcacattcacttgtaactgaagttggctttattatattaggaactttattccctagggtttcataaatagatgtactgcttaatttattttgacttaaatggagctagtttcaaattaaaaggccaagcaatacagaggatccatatcctcaagtatgtctaataccaaggaaacagtttttatgtatttttggtattgttttatttactatatagattacttagagtttataaaaaaatctaatgcctcctttataagtaattttaaatcattcattatattcttaaatttataatttgtcagagtgaacattatttttggaaaaacaaatcatctcttttaaacgctatatggaaaaaataatttggttttgcaaaattttcttggtagtcacattttacagaatttttgttgtctgaaattagagtttcatgattttaatttaagcaggtagcaatataaaatacttaacattcccatgaattacctgtgcagcccagtttctcatgtagcattttaatatttacctttgtcttatgtatatttaattaaaataagcatgtttcctttaataagtagctttttaaaaatgaatgaatgataaatgaactgaaattcgtctgaaaaacccatatgattattttttaatttatttaaaaatagaatcaatgcttacattttaatacatttggattcacataacttgaaaaattttagagattaccgaatatagattggaatcattaacaatattttaaaagaataaaggcatgtataatttttatggttcattaatgtttaatgctaaaagcaagatatacagttgaatatacactatgactctaattctataaggaagtatgtagtccataatagtcacatactatattgcatacatgtgctcacatacatgcagtgggaaaatgttatcaatagttatctttgaatggttctttaagttgttctatatctcccaaagtatgtatatgtatgcatgtacttcatatgtgtgtatgtatatatatacatacacatatgtatgtatacgtgtatctatacatacacatatgtatgtatacgtgtatctatacatacacatatgtatgtatacgtgtatctgtacatacacgtgtatgtatacgtgtatctgtacatacacgtgtatgtatacgtgtagctgtacatacacgtgtatgtatacgtgtagctgtacatacacgtgtatgtatacgtgtagctgtacatacacgtgtatgtatacgtgtagctgtacatacacgtgtatgtatacgtgtagctgtacatacacgtgtatgtatacgtgtagctgtacatacacgtgtatgtatacgtgtagctgtacatacacgtgtatgtatacgtgtagctgtacatacacgtgtatgtatacgtgtagctgtacatacacgtgtatgtatacgtgtagctgtacatacacatatgtatgtatacttgtagctgtacatacacatatgtatgtatacgtgtagctgtacatacacatatgtatgtatacatacacgtgtatctatacatacacgtgtatgtatacatatatacatacacgtgtatacttatatatacatatacgtgtacatacatgtatgtctacatgcatgtatgtgtgtgcatacatgtatgtctacatacatgtatgtgtgcatacgtgtgtgtacatgcatgtgtgtacatacgtgtgtgtgcatgtatgtatatgtgcatgtatgtatgttgcatgcatgtatgcatgtgtatatatgtatgtatgtgcctgtatgtatacatgtatgtatatatgtatatatgtgcctgtgtgtatatatacatgcatatatgtatatatgtacatgtgtatatagatgtatgtatatatgtacatgtatgtatatatacatatacacatacacacacataaagatcaagtaggttacattatatgtttgttttatatgtccatacttctatgaagatgggtctagagagttgtgagtagacgtggtcctcctatagctaatccttgggtgttgtcaaatagtctaggctcccagaaatatttttatattcattttaaaattagaacatacttgtttctctataattctaaaagaagttgtcaagggtgaattgatagatggatgatagtttttaggctgaggaaagaaagatactaagatttcaaaattatcaaaatcttggactttaaaatatatttcaaaaatattattttaattttctatatgtttatcaatttcctaatcctattgacaaacttcagaggagaatatctttctagtaagagtgagtgaagcacagaagatgaaaaaagtttgcacaagattccattcggccagcgcggtggtgcacacctgtaatcctaggcaccccatagactgagacaggaagatcacttcagcccaggagttcaaggccagtctgggcaacatagcaaacctccatgccattgaaaaaaaaaaaaaaaggattagattcaaacgtaagccccagcctgtgactccttcacagtgctagttcatgcattcatttgtcatgctaaaatttgcaatgtgtgatattcaaaagcagtgggtcttacatggccactaatgctttaaatatagtaggattaggggtctttgctccataaagtaaaaactttcttctaattaactgtatctccttttccttatgatttcgtaatagtaaaacagataaagattgccacctagtgtgtttaagatttcaaccaatcatgaaatgaacttctataggaaattatattttcaggtgctgatgttggttgaacttatttttttaagatgacaacaggctttttcatttttaagtacttgaaccatatatggatctcaacaaagtcaccataagagtgtgggcatttggatttcttgcttttagtttcttgcttgtttctgtttccttattacagaaagaaaaagggtagaaaataacgtgataaataatacagaagtagaagaaggatgggagggggaatagagaatagaagttcctgactctactgtcatttctcttgtgagaaaaaaaaagacaatagtatactgttgagccctgtattctcctgctttcaacagcgctggctcaggactcagcaagtctttctctttgggagagacaaggctcgccaggactagtgaagatgactctggttcacttcctggtaaccagggaaggtgacagagcatgtggcacctccttggacatcatgaaatttaaaaccaatgtgacactgactcccacagtgacctacagtggctcatcctggctgttctagaagtttctgcacttgcattctgctgtgactgttaccttggtaccaatctcatctctcacatacatacatatgtgcatacatacatacatgtatacatgtgtgcatacatacatacatatagacacgcagtgtcaaaatgactttttttctgagccttcctatccctcattcattctccgcctgtcctccatgaacactccagttcttttttttaaaagagctgtattttccttaaaacagatcacagctgttttttgttaagggttgttgttgttataattgtttttatttaaatgaaagacagtattgcatcatcctcacccaaaattcacattaccaggcggtacaatttcaaaatgtccaggcgatattcactgtgtgactttgaatctagcttttcagtcactttatagagaccctaatagtctcttcccatctcagaagagactcagaaaaatatttagccaagtaggcctaggaagccccaatttattacattgtattgtaatccctcccagccccactttacgtggcaaggcgctttaaaaagcttctgtgggtaaagttgttcaggtgcaagatttcagaattattttatttcataggatttttttgagcatatgtgattattcagttcattaaaacccacacatactttaaaccaaatcatattcacaaagtgaatcttctgttgatcttaactaccagatctgtttttaaatgattataagcaaagtgtaagacacaattcaaagatatgtttgtattatatttattttcttctaaccacaaataaaaataggttttacttgccttattctcctagtgacagtatgtctgaaaagatctgttttaatattgagttgaggacttagacaaagattttaaaattatatgttaggtatatattcaaagataatttaagcatgacatacttttgaaaataaatggataggctataacctgccgtttatcgaggacatctgccactgaaatgctaggtatcattttactgttactaaaatgagaccatcttgagatatttggcagaaacaatttctgggcaatttattaaaaagtaatatatttccttcactaaaatgataactgtctttatgctttcatagggaaaaaaggctggtaaattatcataaatattgtaaagtgtattacttataatacttataaaggagatacaaccaaagagaaaattaaatgttttaataaatatgcaacccttttgagttttgaaagattcaaatccactgcaatctatataaaaaattaggagacatatttccatggattcatttcagattgatgatgtgccttgtcaagatgacttagtcctgaaaaaaataaactttatagtaggtcaattataaagaataaaatgaaagaagagactatagcttgggacaataagaagatgtcatattattttaattttggttatctgaactgcctctcatccattttacaatacaatgtcttcagcttggccatgcactgaagcagatgaatagtttatcagactggcaaatcaagtcggcataggtggcatgtcttttctccttgtgtaatatacctcccattatggaatttttaataacattttttaatgtcagaaaccattgaactatcttgaatgcaatatatgtagtatatacacctattgaaaatgttttttgtcttcggacttctaacacactacacagtttactgatttgtccaccactcccaagaatgtttggcttcaaatgaactctaaaggtgcctttatgtgtgtagaaatttgtcaaatgctgaagtgtttagctctggattttgtcttcatgctttttaaacactggtgtatctgtaaatatttctcagttgttttgtgagagttaggctactgtttcaaaataagtacataagagaaattgcagccctatatttacctatatgacacagccagaagggaaagtcagaatgatgggccaaggaagaaatgtagctggccaaccctggcatcactttgtaatttgcatttattgggccattttcctagagctttatttttaatctttttaagctgttccataggaatcagccaatgcatatcacaaaaggggaccattccaggtatggctgtgcagcttactacctgcgtgtctttgtgttaaatctcttaatcaatttgagctacaattttctcatctgaaaaatgggagtaatgtcacctaccttgcaacattgttgtaacagctgatgattgtatataaaatacacttgctgtgataacattctttttacttttgtaaatgcttgaaattttcatatctttttttccccagaactttttctttcccccagagcttttaatgctgtcatcgtccctctctctctctctctcaactaccactgatttagtttaggtcctcatctcttcttttctctacactggtctccctgcttccatttttgcccctttaaagccctcaatcttttatagacctgtcacagggtctcaagagtccttcttagcgaagtatcagttttctgagtctttgcaatttcctgactgcataggaaagcaaaaatcattatgatttaaaaggttttactactgctgctaattattattatagaaatgtttattgaacatttactgtgtggtaagcacatttttcagcacttaacattattaatttattgaatcccaaaacatcactctatgtatgtgctgttatctccattttacagatgaagaggccaagggaaagtgaagtttaataacttgcacaatttcacacacctagtatgtggcagagctgaaattccaacccaaacttccatcagagagtaaaatccaagttcttgtacatttcatacaagggctctgtgatctgctgcctggctcgttaccacccatgattctgaatttcctgccttccatggcattctctagaatcaccgagcttctcgttgcagctctgtatctgcttctttctcatctaggcagctgctctgcctccttggcttcatccctctctgctggctcccacgggctcaatggcctccttgccacttcagtgcaccaggcctgctcctaccctgggccattgttctaggaaagagcctttctgggcttgacctcagaagaccttttttttttgagagtcaaggtaaattatgtaaattatttattgatgacagaagaacactatcttagtccagtttctgttgctataacagaatagcatagacagggtaatttatatagaaaagaagtttatatcttacagttctagaggctgggtagttcaaggacatggcatcagcatctgattaggatatttgggatgcatcatcccaaacaatggaaaaatggaagggcaagtgagcacatgcaaaagagaaaacatgaggggctgggctcactttataacaacccactcttatgataactaaccccctcccaccataacagcattaattcattcatgagtgtgaagccctcctgacctaattacttctcacaggcccccacctcttaatactgttgcaatggcaattaaacatcaacatgggaaaatacctttttcaattgacatcctgcctctaccacttattagtttttagaccttatgccctctctgaacctcagttgcctcttctataaaatgatcataaaacccaatgtcctaccttcttagagttctagagttctatgaataatctctacaaagagcaggtgccccttgaaaaacatgattctggaactaagggggtgtaaaataacacatgcttcctttacattgttttttccttcttctgcttttatttcccacatttttattttcaagatctccacatggtttgatgacgaccacagcacctattctagctattggtaacaatttattgagtaacatcatccatatgctccctgtgccccagcatgtttcatgggtgttgttttgggtcactcaggttgttttcagattgttcatgagtgagcgaaaagtttatttgcactgttctcagggccatgtccagggagctgtctgtgttgaataacagcattcacttttgatttaagaattttatctagctagatcaagaaatagctgatggtgactctggaaatccttgtctcaaattattcatgctaagaaataccacaaaagaaccctgggccccagtttctcactttcctctaactggaatgttgcacaactttccttgcccttccctgtccctccaagacacgtcatgctgacaccttgctcccataccccaggcacggtgtagctggggttgctgcagcaacagcacacaaggagtaacatttcccagtgactacagtggctgggatgagtcagttgaacatttcactgggtttttattagtgtatgatgcagtcccatgtcatctacagttcctagcctgtccaagacttacacgggatgatgtggaacactccatgctaatcaccttcaaatattagatggtcaagggttctctcactgaagtcactgcattgctggttccttccacagcaccccttactaatatctacagtaagaggccaaaagtaaaactcaggccccactgctggaacaccatttctactattgcatatcctgtgtgcctaaaaagcaacagtgaccctggctgatgatcaagaagcccctctttttacccagggagttggacaattgttaacatcccagaagacatatttttaacccagttgctgggaagaacatgtgctgaagtataaggatggaatcactgtaattctctatgggaactcatgaaagtggaacttgccgtttaatattgaacgacactgagcacagagttattgatgatttctaatgcgggatttggtttatttttcagacacggagatgacttgattgtgactccatttgctcaggtaagcacagcttggtgaatgggcaggtttctcacagatgtaaaaatttaatttggggaattagttcgggttattaatttaatttaattttaaatcaagcacaagtacaaatacaaattcttggttcattcaagcaattcaaaagcaatgctagagaaagtgactttggctatattaatctgtttcctataaacccatagtaccaaagagtgtctttgcttcaaataataaattagctaagggatatacttaattgggctcatactgacataagcactagaagcagaaggctatatcatggcttaagttatgtttagtataattaggtacatgatcagtgcttgaaattcaatattccaattcaacccaataccttatttatctcttttttacatatgccatttgtgcagagatttagctgagtgatgtgttgatgtttacttcttccttctaggcatacaaatcatgaaaatactttaaccacatgacatatgtgcaagcaggtgataacatgatctaaaatgtttgggaatataaatatgaaagagttgatgaccagatgttctatgtatagaccaatacttctcaaccctacctgcacgttagattaacctagagacctcttatcccagtgcccaggctgcagccctggtcaattaaatccaaaaatttggagatctgttacaagcatctgtatttgttaaaggccttagtatttttctagtgtgcaggagaagttgagagtctctggtatagacaactaagggcggaatgagataaaactgatttaacctggggcatgaagcaggtttaaaaccaacactgatgagtaagaaatgttaaatattaaaatgcaagtaatcctgagaggttgtaaaaattataatcaggcctatatcatacatcaaggtgctcttgcaccttggacaactcacttaaattttctgggtcctcttttttttcaactggtagagttaggggactgagctggatgaaagacagtcagatctagttaaaaccctttcaccgcctcttgccaactcaatggacttgagcgagtcactgaacttttccaagcctggtctcttcctctgttaaataacagttccaagagtacccacctcataagattgctaagacactgaaataataccacgcttataaaatgctaggcacaattgcttgaaaatataatattataaaaactttgtgattggtttaaatgtatagagctgaaaatgttctttcatttctaaaatgtcataagtattattttttaaatggataatagggtttagatagtaggattatgtatagttctactttttaaaactttccaaacttttattactgtaacttagacctataatataatcaattcataagtaacataatgtataatagtaactttttaaattaatgcaggcaattaaaaataaaatacaatcaccatccttttcagatggttaatatcttgtttgctgaaggttttgctggagattatgaattctttctagtacctgtatttctgtgtccaaaaaatttacacttgtatgatttaataatatgatgtgatagcaaaatcttataaagctgagggtttttaattgattactattgaaaacttatggccgggtgcggtggctcgtacctgtaatcccagcactttgggaagctgaggtgggtggatcacctgaggtcaggagttcgagaccagcctggccaacttgatgaaaccctgtctctactaaaaatacaaaaaaattagccaggcatggtgacgggtgcctgtaatcccagctacttgggaggctgaggcaggataattgcttgaacccgggaggtggaggttgcagtgagccaagatcatgccactgcactccagcctgggtgacagagcaagactctgtcaagaaaaaaaaaggaaagaaagaaaacttataattctatatctaagacctcagagagaggtgaacagacaaaatatggcataacaatgtaagtaacatcatcaaacatagaaccaatcattccaatttgagttcattcaagtagctattcttgtttctaaccaaatgatctaggtattattataagaaaaaatatatataaatatttaataacaaatgaaaaaaggtctgtgtatgatatatggtcttttacatcaagtaatatttattaagctgcaacaaatagattagtaaattggacttgaaccctgccatcagtgctcttaaattccaaggaaatctagtcttttacctgattagatattttctgtagtgtacctataatctccaaggaaaaaaaactaatggaatttcaagatattgggaaatacacacatatatgtaatttagtccatgttagtaagctatttaaataaaaaagatgtgtacttaatatacttgaaattagaacttggaatataaatcagctgtataatttataggcatatctgatgcctaaaaataatcccatagtatattaagtctttgcttatgattagctaagtgactcataacaccttgtagagagtggtcattacttgagaggctgccgattttttttaaggggcttcatcatggttttcacaaatggccttttactggagtataagacctggaaagccccactagaattaaaaacaaaacaaaacaaaaaactgttaagccctgaagagtttcaccactcttcatagagcatctgtggggaggggttaagagagaagtcccagtgagtatgtttgagtggccttctcttaaaccctgttggacatgattggcatgttttgctgacccaatcactaacttctcaaattttctttaatacaaagtaaagcacttaccacttaatggtaagtgctattttagcattaactatttaaaactaaaaatataagatacttatgtcacttgaagtgataccaatctaatttgtcctgatataccataattgctttcaccaaaggacagaaaacaatggattttagaaaagtcactcagaaaaatatttagccaagtaggccaaagaattaccctcttttctcagcatgctttgaaaattggaatttcacactaaattccagtgaaaaagctatgcttctcaaaaagacaaaacaaaacaaaaactttttgcataaaagtttagaaaaataataagaaaaagaaaaggaaaattttctaaaattccaaaccccaaaataactgctactgacattttattttatatcccttcagatttatttttctgtgcatattttctgtcccatggctcctaaaaatggccttcccctgtctaaggtgttcaaagatcccctcccaaatccatctcatcttctgcctcttcttgagaactcatttctttatgcctgagtccatctccaaaacacgaatcatggtttccaaatcatggtttcctttgacgtgaaaagagcaaaatcctaaattagaggagaatttaggaagccgtgcaaagatagattgcacttttttggccaggctaaagcctgaaacatcttggatagtaattttcagaaaggatcctatagtatctctccatagtttatcccattgtctaaaacactgtcagggctagaaattcttgctggtgtttaacctaaactcttttccacctctgatttcttatgctttcccctgtaagctcagaatccctttggtcctcagaaaaagtgacagctttaaatatttttcttatttcaattgttaaagtattctcttgtgtttgtgttgaaatcttttggtgtgggtgtttccttagcacgaaggctagagaggaatcccactggagtgcacgcggcaactgacctttttttcttggccagagttcttgggggccaaggagcactaaggaggcacaatgctgataaactgtaggaaactcttctctgctgtcagctgcctccgggctcagtgatcccaggatttgtgacacaactaccctgtagtaaaactctaagttgactagaattttcatgtggaagtgtgtaatgttaaatgaagtagactctgatgaaagaaagagaaaacaggaaaacccaagcattatgctggatccctggagaaaccctcacttcattcagactaaggagatatccctgatttgaaaatacagaggcgggagaataacttgaacccaggaggcagaggttgcagtgagccgagatcgcgccattgcactccatcctgggcaacaagagcaaaactccgtctcaaaaaaaaaaaaacaaaaaaaacaaaaaaaaaaacggggtaggaacaactacatctctttacctttactctaaccaaaatacagcacctgggatacttctaggataaaaatgcagtagttattaatactatagaatattaccatttagttggtaataaaatataaccaatattctcatattcctgcctgtccctcagccacttcacccagcagcaacgatcttgtggcctcatcaccatcctcaagcttgcagactgtgctaggccctccctgccaggctatgaaagaagatagtcacctcgtttcagtcggtgctaaatttttagcttttctttagccttaattaatttaaattacaactactatcttctggacatctaagttctttttaagagcgaaccatataaaattgtctatcaaccttttctggtgtacaaaccagcaatttcatagggtttaaacaaaacataacctggaaagaggttttcttttcataaaaatgacctttctattttgtaaataagcataacttgactccagctttttccggaggtaaaaccgaagtaatgaatctctcccagtgcgggtcgccgcttcctccgccgccagtggcacctcaacctcatggtctgtgttttaccgccatctagtggtaacaagtgtatatggttatgaaaaacaatcctcgaaaccatttattttcctctttttttttaggctatgatgttcagctgtttaagtgttaaatgataaccgtattttcctgctattttcagtgattcttattgtttaataaatgtttagaagcacctaagaagatccgagagtagtgtacgtaaataacattgaatccttccccatgggctaatacatgaaccatctttgtctaaaatttttctgtaaaactaccagtatttccttcctaaggaatatatatttctcatcattcccaatgtaattttgacattgactggctatacttctgcttggtggggcagaagagaaagaaatgaccttaattttctaaccattgagctctgtggaagaaacgtcagggatctttttggttagcaagcattaaggagtaaggacaactgtaaaaggagccttaaagctttgactacagttcttaaagagtcgaattcaggggaagtgagggctgccctgaacaaaagcaaagaacaatggaactttaacttaggggcttcagtaaaactgtttatagttctccccacagcctgcagtaacagatgctccctctttgtgccctgcaatgcaaagtgaaagcttaaaagactaacacagtgataacagtgatgacgacaccaagagtcagtcagcgaggcccaagacaacacccccttataagatttgtctagaaatgttatttacacttctgccaatagcatacatgtcatactgtagaagataatagttaacaccaaacataaaatttataaaatagtttgtcctgctgcaaaagaaaaaaaaacccacacacacacaataaataatctaatactggcatgcctaggaaataatttctctacaagattatttattgcaacagtgtttgtacaaaaacaactttaagatagaaaacctaaaagttgattgctagtggccaggcagctgattgtctgaaggagagaccggaagacagattccttttttcactttttattttgaagtatttcatatatataagggaatatagcttgtaattatgtaaaatataaagaataatactaaaatgaacagtttaagaaatagaacagttatcagtattttaatgtcccctgagtgtccctccccaggttaatctgtttctattgcgtcttttcagaagtaataataattttgatttttatcttaatcattgaaggggagactttttgctttatactcttttgtttaaattctgaagcatgtgaagatataaattatacaaaaatacataaattttaaactaaaaacaaagacaaaataatattaaattagattacttattaaattagaagtttattataatagaggcaaaaactcctctacagaaattttttctttgatgaactaatttttcttttcatgactgatgtttcccttcaaatgatcatagaaaataagttgcctgcatttctatgtctatttacccagctgtcaactgcaatgaacttaactattatgtattggaataaaaatctcagaattctagggttaaaaattttgcctaggaaggggatcaattagctggtgcaatgattttatcttaaagtttccattagtatgtttgatattcacttcttaaaacataaattaagcctgcatgatttaacgacagtggatcatttatccgatttacttctgcatcattcaagatttcatgcctaatgaaagacatcgtggtctgatgtcagcagtcggccatttgaatactccatcataggcagcgtgacctttcagagccgtgggttgtttatatgagataatgagccaggtttttccagtgactgagttaatcacggttggcttcttaggaagcagcattaactcctttaggggaaaattctctaagtcactgtcccaaggcgtacacagctctccattgacttacacaaatgaatgtcaatttcataaacagcaacaacaaaacagagtctgggacatttttgtcttagaaaaaaaattagactgattttagtctaggtctgtgccagatgaaacatttctgaaaacaactctggaaactttgaagcaattaaaactttggagactcttgaattaccaatgctaggcattaagtaaatttcccaagtgcatgccaagtcattaagtcaaaggtaacgctgccatcatgggctaatattggctgaatgctttctatttgccaggcactgttcttggcaccaaacctgtcattccatatactcctcacaacaattctacgaggtaggtatcactatcccagttttccaggttaggaagctgaggtacaaagaggttgcatatctagtccaagttcacacatttactacataacagagccagacagtctgggttgttaggtaatacctactcagacatttggaatctgtgttttacataaacttagcactctagctgtcacccaaatcacctataatcccatctaatatgggtttgaccctggggaaacttgcccatttcaggagaaagagaggagggaagaaggagataaggctctaggaaccttctcctaggctcacttccagtccgttggctactttctagttccaactggaattagaaaaagcgactgttagagatagtgacacctattggtcctgccttgttatgtgtgtgggcatgttgtgtctatgtattcatttagtcaacaaatttttattgagtatcttctgtgtgccaagcattgtgcatgtacagggcgtagcattttacataagaaacgcatccctgagagcttcttacaatgcacaattcagataaccttaacaaaagaaaacaatgtctgcttactagctagagtagccatgtggcaaaggtagaaaaacagtttaaaattcacttcacttgccaacttattattatgagattcttcatcaatttttgaagagatttgggagtagggaattttttatccctaaagtgagctttattagcattttatattatactatttgaaatgtgcaaaaatgcaatcatgttatctgtgtattgcctggaatattgtcttggtgactaaggaacccagaaatactgtggaaactgctgctactgtcaccatgtgcatagacaatgtggagggatttctggaaaatttctgcagtctggcctctctggatttcgtgtggatacctacaaactgcactaagtgttgggagattctttagtggtatatgaaactaagttgcaagcaatatcaagttttctcttaacaaaccattttcaagtgtatttaaaatggccttagctcaagaagtttcaagaatcctttcttgttgtaggtcttggccagtctgcgaactgtacgaaacaactttgctgcattaactaatttgcaagatcgagcacctagcaagtaagatatccttttttcccccctcttttttgctgaacttttaaataagttttctcaacttgattgagcccaaggcaatatgttagacttctctgtgttgttgccatgttgtctgtgtatactaagtcatatgatgtcctgttaattttctataaatacttcgtggtgatggttctaatatcagaaatgaagcagtatgacaaataaatatggtgattccatctgtcagaaatcacctggcatgatcagtcctccgcccagttatttacactcagggtaactttatagtttcggcttacttcataaattaaccgtgggtgaataatctcatcacaccttaagatcagctgaaagtcatcctctcaagacaacgatgatttggagaagcgccatatcatagcaaagatctttgattctcctgctgttactgactttcagatcagcagcattcatggagcaattaatagaattgtggtttatatgacaacagggaaagcatttgaaagatgggaaaggattatcatttcaggttcttgataaaggcaaaaaaatctaaaaagataaaagtaatttttcaatattaaatggaaaactggtttgctgttatttcaatgtccatttttttaaaaaaaatctgctattaatatgaaataaaatattaaaatgccaacttcaaataattttccagaaggaaaaaaaacatttaaatcatattaagaggatagtaaatataagtgtattaggaactataacttacctaagtgcataacatttcatagtagttactacttcttaaaaacaatgagaaatctgaactttacatttcatagtaataaaattgacctcccagattcacgtttttcattatcaaaaatagctctggccgttattcaagtacttcttgtgatagaaaaaagtttttaaaaatcaatataaatgtaacaatgcaagctattggaatggaacccattaggttctgtttttccaggtaatgaatttttgcagtcctattctctcagcctgaatacttctcatcttcttcttcctctcctcatctactgggataattgtcattcattcttttggttgcagcttaaataaaatttctcttggagcattgtccctgatgatacccaacatagacacacacccacaagccctaatcaaagtgatgtgcctttccatctctgtctgattgtaccttgtacttgattcctatgttagcacgtagctctctgtgctcctgttgcctgtttgtctgttgggatgctcctgaacactgtcagttcccagtgagtaggaatgtagtcggttcacatttgtattccctgtgcctagcataatgcagagtctatcagtctgcaaaggcctgttcgctgaaagggcaaagtagtaactcagcatgtaaaatctgagggcatgctttgaggtacctgttcattaccaatcacgttttctatgtaacgtggccgtgcaatgtcatactgacctcagcggcccccttgggctttggggatttggtagcttgtaaggtcaatcacctcccccttagaaagtctcagctctgcagaagaaatgaagttaactggttgtcactcccaaactttttagtctcgaattttacccaggaaactgagatttttgtctttaaaaagtgaacaagaaactccctttatgcttcctttacatgtggtcacctgggtaccagcatttaaatctgtggcaggtaaatagttgatcagtcaggctccagagacgatctgaggcctgtttctatgcaagacagaagttttcagctgacatacagggatggaacagattgaaatggaaaggaggagctagaagaaaacagaaaatcatagcttgagcctgaacttcctctctgccttgtcaatgcccagggtgacatctaaccaaacagtattatctggcagactctaagtaaaggccactgtggtcttccttttggtcaatgcaaatttgtgcctccattactgattcaaaccaaatcggcttctttgggtatcagaatagtaggattcaatctattcacggctaaactcgattctgttcagtgagaacaaagtgctgtaactctgcctcatcacatgatgaccctgggagaatcagaacctttcctgctgggcactcacagagccactagaacatttccaagctcatccttggattttatggaaggcatgtgctcctttgcacaagccaccctttttatttgctgcagaaaaggagtctaggaagaatgcattccaaacccagcccctgggtgggtattcagatgcacattgctgacttgttaacacattactgcttcttgtcaccttgggttttttgtttttgttttgcccttgagattttttattccagaagtgagttctggctcatctgtcattagaggaggtatcgaggcaaccatggatcaaagtattaatattttctgcttgccattacttgttcagatatcaagttcctgagtaccagttaattgtaggattgatagtaaaaggagataattagaattgagtcaaccatttggttttccaaaactgtagaagagtgtgaaaatatttatttaataccattcccagacaaaatcaatggtttctaaattttcacagagcaaggactaaaaaggagtaatcaggatatcaattatttgaatgataaactcttagccagaaggtaacagataacaccctgttacacacagcaagaccccatctctaaaaaaaaaaaaattaattagccaagcatggtggcatgcacctgtagtcccagctacttgagaggctgaggtggtggggggaatcactagagctcaggagttctaggctgtagtgagctatgatcacaccactgcactccagcctgagcaacagagtgagaccctatctcaaaactttaaaaaaaaaaaaatttaagaagaagaagataattactggtatatagaccagagctatttcagagcagctgcttaaaatattaatattttggtttatcgagtttaaattctccccatttttcccccaaccattttattttataactaaaaaaaactaaaataattcagaagtaaaatttggtgcattttcaatcaaacacaaaattttaatcccaaatcgataccaataaccttaggagcaatgaaagggagccagaggctgagtggaaccagtgagaatttacaaaatcccaggctgctttccccaactttcccccaccctgctaagaaattcatcatctcagcaaggcatatttgaagagattgatgccattggcacatatgtgaggctgtgcatgcaggttccacaaaaacatctcaaactaaggcagcaaagcagagcatagaccctaggatcacattcgtttagttcaaatctcagcttcgttacttaaaacaagttcttcaaattctcaaagttttgtttttctcattggtaaaatgagaacaatgaaacttacttccttaaggcttattgtaaggattcaatgagataattcatttaaagtacttatttagcaatgtctgatccacaagaagtgtttattaagtgttcacccttggtagaggcaatatatatataattattatatacctaatatatatatatatatatatatatatatcagacatctttgaatgtatctaaaagtgttttttaatcattatattttaaaagctgtcagttacaagtaataactttataaagttatatttcaaaaatgttgatggatactttataaatgatattcttttcaacataatttattaagcactgacggaatactggatgcattgtgctaggctctgtagggaatataagttaatcagacagcatgctttttttttttacttcaaggggtttatagtcattttgtggaacttggcaaacatctgaaaacttagagaacacaagatataatttatttaagtacctttggcttagagtatttctaaagcttctatagtatctatttggacaagtcattaatatacctctctaacaaatatatcagaggtgtttttcaatataagaaaagaaaggaaaaagttcaaatagcttctctaattataagatagtttacaacaaatcattcacttctgataatgtacaggcaatcacgagaatttaggccaacaataaaaatttcttaaccctgtattagggaagacaattataaattgactgctttttcaaattcagagtctataagctctggcttcagcgaataaagtctgtaagaatttcctcttctctcatgtcccagtgacacttacatcagctttatttaccccaaatcaatcactgtgagatttaccagttttctttttggacatgtgtgatctgagccataatacaaagaacgcctagggacttgtctggctagtctgaaagaaatcatttgcgtgtccaaacttaaaaataattctttaaagtaaaatgctatatctgaaatgactcagagagtgatcaaatcaataagccccacatatttactgctttgtgtttttctgtctttgtcagaagatcacccatgtgcaaccaaccatccatcaacaaagccaccataacaggtaagaaagatctggagcttattcttcatgtgtctaggaagaaaccatttctgccaagagtcaatataacaccaacaccaatttcatgctgcaatttgaaaatgttaaagaaattctttcttctctacattatcatttctatcattgatctcacaaattgtctaagctgttatttggaacatttttaccgatttacgttttttactgatgtacattatttttaaccatttaactatgtgcttatactcatttgagcattgctctgggcatttgtattttgagagatgatgttactttcaagtcacttcccattctggttccacacatgtgttattagcatgatataatatgtcatcatttagtttaataagagtgaaggcataaataaaaggagtaacgtgttggttcatcaatatcccacttgtgtgtaggaagcaacattgtaccagtagtccaataaaggactgagagagctgagaataaactcagtttgggaggggagagaagttaatatacaatgcagaaaaagttcaatgagatcaaaacgttgggatctatagatgtttgggaaagaaaaataggaggaaagatgagaggagccaagtgcataaaaataaaattatctcaattcctattagtctgttttaggcacaggacttgaccccagctgaaccaaaaacagaatgcatgatctcattttgctgaacctgaaaccaaattgaactcttttgactatttcttgaaaccccaattgattcattaaaataattgcctggaaaagaaaacctatgttttctaaaattattaccagaagaaaattagcatattctccaaactaaaacaattcgtcattggattcaagtgtcttccttgagctccaacccataatgtgctgaggagctcttattaagttattagtgagtacactttgcttgaaatttaactttatcatgtccagacgtctgtctgtgtttgtggtcaccacattagagttgattctggaatcattgttaatgtcatcttttctgaatgtcatcaagtgaaacttgtatttcaatgaatgttaaattattgatctcttcttcatgtttctctttcaacatattattggtgatgacttccaattatcattttatagtacatatatggttaaccagttttgttcttgatattgatcaagagatgaacaatagggccaggagtggtggctcacgcttgtaatctcagcactttgggaggccaaggtgggtggatcacttgaggccaggagttcaagaccagcctggccaacatggcgaaaccccatctctactaaaaatacaaaacttagcatggtggcgagcacctgtaatccaagctactcgggaatctgaggcaggagaatcgcttgaacccaggaggcagaggttgcagtgagccgagatcgcgccactgcactccagcctgggcaacagagtaagactgtctccaaaaaataaagagaaagagagatgaacaataacaattcctatatgctaaaataaatactttgagtaactgatttcttctgccaaaattcaaattcaacataaatgagtctaaactgagttggaggtgtggaaccggatccctctgtttctatgcactttcctaagttgaggaatggacaggcctacatttatgaacctgtacctgaggcctctagtgagagaagccacatggaagctggtcttcacgctgctccaggcactaaatctgacccctatcaagaggaactaccctcaacccccaattttgcaataagcaagaactgacattgctatttgggcagaatgcagtgctattttggtccctggaagcttttttagcttgaggtcacatatgagctggcctcacaggtggagcagcattctcccagaagagcagcatcaggtaccagtggaaattgttgtggctgacaacagatggttgggtgctcagtggtcagggcagctgcccagccatcccagcagatgccaggcacagattaacaggagagagtagctacactcaaagggcacacacttgatcttaagcatatgtgacagacctcatagaagctcctagaaatgtatacatagtaagggggtcctggagcaataccagagggaattatgagccacagaaattaagaaattaaggtgaatatggcctcattcgtacccacaagctcctgacctgaggcctagggacaagggggacacagaaataccttatctagaaagggaaactaattaactgttgttaccacttagtgctgctgggctcctcacaaagcacaacaggaaatgaactgactaaaactgggaagtcgtttttcttgcccaagcatagcaaaccaaggtgggaacatggcatagggatggagggatgagggcagtagcaggggaaggttcccctttctgagcccattttgaaaaagtgggcccttaaaacctcagtgctagtaataataatgatggttgagattttgacattagtaagatttgagacactcagaaaaggcagtgcttgtgcctttcctccctctgcagctgaccactcaggccccaccctctaggctcactccccctgaagttggaacctggctgtactgtggcagtagtcctgggaagggcaaagaagtattaaaaagagtcagtgaggcacccttaagatgaatgggtccctgttgataggggtcagacctagtgcctggagcagcatgaggaccagcttccatgtggcttctctcactagaggccccaggtacaggttcgcaaatgtatgcctgtctatccctcaacataggaataaggtctagagtaacagtgtagcctaacagttaagttcatggctgatccaaaaggctgctagagcacacagctccaagtgcctccggagggcaactccacagaacatcacaacatggtgcccctagaattataccacgtggttgctctgcctacccagcactcaaatcatgctctatcatgagagctttgtggccctgggcaggttgcataccctttctctgctcagtttccctacctataaaatagtgacactgcttcctgcagttgttgctggcttgaatgagtgaacacgcatgatgcccttagcatagtgcctcacagaaccagcacttaatacatctttttaaattccattttgttgttattacttggttttgtttctagggcccactgtatacatagaactaggggtttcttcatcaattcaggctgccataacaaagtaccatagactgggtggcttatagacaacacaaatttatttctcacaattctggaggctggaagtctgagatcaggatgccagcatggttggggtctggtgagagtcttcttctaggttgcatcagtgccctttgtaaaggcactagtctcatttgtgagtgttgagtgctccaccctcacgacctaatcacctcccacaggcccggcctccaaataccaacacatattgggttaggatattgaaatgaattttaggggcacacaagcactcattccgtaacaagggggtaatggaaagaataggacaaagacacaaacgaaggaaagggaacagtgagagaaaggcaagcttgcaagatcatgagaggaaaacttgtgggtccttaaattggccaaaatggatgcgcttgctttgtgcccatcaaaatggggtctcctcctgctcccagcactgtctcctttattctcatcacaattcacagacgctggtagctttgtgatagagatgatacactgttgttcaggatgaatttctaagtctaagaactcacttttgagtcatagttgtttgaaggagaaatattaattctctatcacttttctgtaaaccaactctaatttttaaaaaagaagagttaagaacttcagcagtctacatatcacataccatgctttctaaggagttgtcacatagaatttacaataccctcttcctcttttcaaggttattgcatttgacatgtattaaagccaggagaatttgatttttttttttttttcttgagatagagttttgctcttatcgcccaggctggagtgcagtggcgcgatctgaggctcactgcaacctccgcctcctgggttcaagcaattctcctgcctcagcctcccaagtagctgggattacagatgcccaccaccacgcccggctaactttttgtgtttttagtagagacagggtttcactgtgttagccaggatggtcttgaactcctgacctcaggtgatccacccaccttggcctcccaaaatgctgggattacaggcatgagccaccacacctggccgagagtttgattttatagcattagggttttaaagctaggttttaaaggtaggtcactggccagtttttatttcaatatatagtaggtaaacatacaggtctaaaatgatctaacaattccttaaaagtaaggctttgaagtttgcatttataaaagagacttaaatagctcttttgctctttagtgtgatatgacaaagatgatgtgtggcatttggagcctgaatgtgaacccagtctctcctttttgcttcatttcctcattttggagatttgagtacctaacacttaggactgttgcaagaattcaaggagataagttatataaaaggatagagttcaagttgggcatggtggcacacccctataatcccggctactcaggagaccaaggtgggaggactgcttgagctcaggaattcaagaccagcctgggcaatgtaatgagaccctgtctcctaaagtaaaaaaaaaaaaaaaaaaaaaaaaatggaggccgggcatggtggctcatgcctgtaatcccagcactttgggaggccaaggcgggtggatcaccaggtcaggagttcaagaccagcctggccaagatggtgaaaccccgtctctattaaaatacaaaaattagccaggcgtggtggcaggtgcctgtaatcccagctactcgggaggctgagacaggaaatcgcttgaactctgagggcggaggttgcagtgagccgagatcaggccactgctcttcggcctgggtgacagagtgagacaccgtctcaaaaaaaaaaaaaaaaaaaaaaaaaaaagaaagaaaaatggatagagttccgaatgtgatgaggaactcaccaagtgtttcttcctataaccctgtcccaatgcctgacatttttttgttcctaaagctaatttaaaaactggtagaatagaggtaacagagaatattggtatgtcagcttctttggtacatttcatttatgattttgttttcacacagtcatggcatgacatttttagtaatccttttatcatttagagtaaggctcacctacatacgtccttaatgtgtggtgcacaccagaagtaaagagtgcattggaacatgagagggtggcaaagagtcagagatgcccaagccatacctgcactgggacagtgatcccatttttgaagtacagccatgtagcttggagcacagtccttccttgtaagcatttcattttcgaacaaccttagctcaaggcaagcattctgcagccatctcattaaatgttacatcttcacaataccattttcaatgcttctgaatttccatatttccaatatgtttatttaatcatcctcaattagaggattttcatgcaaggacacaactctaaagaaaacgtatttaaatatctttattttaaagatgaaaaaactgagacctagtgagagagggtgctgcttagtgacaatgccaggaataaacatgtggttcctttttcgagtccatggtccttcttacacctttataaagtaaaataaaccattagattcgggtggcctttatacccaccgtggaagtatatgctttagagaaagtaaatgaagtattaatactaactcctgagtaatagatgtggcattgtattatttgtatatgagcttgaaaatttctcatcccaacctctcactggacatatctctgtagttatagctattttgattatatctactgcttataccccagaggcatagagaccagcaccctaaagcaaaagacttctggattttgactttggaaaatacaaattcttctacaggagcggtgaaactagtacagctgcctgctctttacctgtagggggagacacatgatgcagtgacaagcatagaacagcacagaagtggttttagtccagaaaataaataaataagtaaattggtctaagtcttcattcctttttgtatttttttaccctgaagattcatggcttcattaaaaacagtaagtgcattctaaatagaatttagtcaattggcacgtagaaaattaaaaagtaaactatccaaataatgctagtctgtcaaaacacaatgagaagaaatttaatcttatatgtttgttgttctaaagcacaagcagtttctaagaattaataagggggaaaaacaataatgatatttaattgggacaattatttttttgttatctgggctaatcacttaatgctttgagcttatcgaatgaaagaaactaagcaactatttcatggtgacaataaggatgctggctacttacttagatctgccttttaaatctgtgtgtgtgtgataaaagcaagtagtatatatagttttttaaaaagaaatatagagagatctaatagatgggagcaagaaccatataaagaaggcaaaagggatctacatgagagaaatatgtaagtcctcaggagatactgaagtaaaacatgtgttgtgtcagtgtatagggaagacaagagacccagccattgccagagaagccctacttcctcatcaaccaccagcaggcagcagcttcatgctgtagttctttttttcctttaatagaataaagattgtggccacactttaataattgccagaaatatgtgttcattaagctttttaagaaatgtgatcgaaaaatgctgatgatacattgtgtttaatagctttaataaaaaactgataaagcatctaatacatctaatgactgtcggatttcctaaatcttttaagctgaaggagtttacttttacaaaaatcctcattgaaaaagaatcttccggtaaaaacattgaactgaaagatttgcataaatgcatggagtattactatttattagttaaacttatgatcttttagagcagtaaaagtcagttctctttcttacaaatgaatttgttttggccttttatgcttttatttaatgagtagagccatacctattaatatataaaaagatcagatctgacaccgtggctttttgaccaggaattgattgaagttagacttgttttaagaatagtgaaaacaagggctatgtcctaattatgaggggaaataatttaattgtgtctctcttgtctgaatatctgatttggatgctttgttataactttaattgaaataattaaatggggctcatgttcatttagcctagcaaaaaggtgatgagctagcatatatgttaaaaacccagctttcctcttagtagttgtctaattttggtcaatgtacttaaattctccaagttttgggggtattctttatcagtaaattctaattcagtgcttaacatagtacttggtactcagaatgtattcaacaaatgttacttatcattattgctataatattattattattattatctgcttggtcaacagtattttccatgcaccttatatatggcatgcatacgctctggaggtaaaatgtgactactggttcaagaaatttacaaagtaagggagaaggaattataaatagttaagtactagctaaatgccatgattgaagcctttatattttttattttaattaattaattaatttttagaaatagggcctcactctgttgcccaggctggagtgaagtggtacgatcttgtctcattgcaacctccgcctcccagtctccagcaatcctcccacctcagcctcctgagtagctgggactacaggcatgcaccaccacgtgtgcataattttttattttattttttgtattttttgtagaggcggcgttttgccgtgttgcccaggctgatctggaactcctaggctcaagcaatctgcccaccttggcctcccaaagtgctgggattataggcatgagccacagagcctggactgaaacctctttaaatatatatatttatataaatatatattatatataatatatacaaaatatataatatataatatattatatattatatattttataaaattatatatatttcttatataaatatatatttcttataaattgtataaatatatatttattatatattatatacatatttattatatatttattatatattatatacatatttattatatatgtattatatattatatacatatattatataaatatatataatattatatatttattatatatataatatatatttattatatatataatatatatttattatatatataatatatatttattatatatataatatatatatattatatatataatatatatttattatatatataatatatatttattatatatataatatatatttattatataaatatataatatataaatataattctcatataaataaatataatatttattatataatgtatttctcatatatatgcttattatataataaatatatttctcatataaatatatatgtttattataaaataaatatataaaatatatattaaataattatattatatatttaatatataatatatatgaatatgtattcatatatagagagagagagagccagtggctctacctaggaaatgctccctgataaatttgaagaacataatgctttccatgtggttaggggaggattgaggattacctcacaacaaaagaccagcaagaataaggtatggaagcatggaatgcctgtccatatcaggggactgggaacagtaaaggacaaattgagttaaaggtgtataggagcaactgaacaggatgctccagaggtagattaaggaaataatatttgaggcctacataaataacagtggactttattttatggacagtggaaaatcattgagcatttccaatcgtaggaacaaatacacatttcagaatgacagtaattggaagcagtgtagaaagagattgaaaagaagaaagactaggggcagccccatactcttcagggggctgtcacaggccttgtacaggatcaagataatgcagctctgaactggggtggaagtggggctgtggagatgagggaatgggttcacaactcttcagagataggattgaagggacttgggggttgattagagcagagactgaggatgaacaattttaaagtgaaagtatgagccaggtgtggtggctcacgcctgtaatcccagcagtttgggaggctgaggcgggtggatcacctgaggtcaggagttcaagaccagcctggccaacatggtgaaaccccatctctactaaaaatacaaaaattagccaggcgtggtggcacgtgcttgtaatcccagctactctggaggctgaggcaggagaattgcttgaacccaggaggcagaggttacagtgagccgagatggcaccattgcactctagcctgggcaacaagagagaaacttcatctcaaaaaaaaaaaaaaaaagtgaaagtatatatacacatgttcattacagcactgtgaatgtgcataaagggttaaaaacaatccaaattctaaataatgtgtgaattctatttaggtaggggttaaaaaattcccataataaaatgattttaaataatttatttttgagaaaattttaataatatggaaaaatgtttgtattttaaggaatacataataaagtgccatgtgggcaataggcacacatttaatgcactttaattatgtatattgaattgaacttaagttacttttagttgttgaccagtagttagcaaaggtagataggtttaccattttacattgaatctagtgacaaacatgttatttctcaggtcccagttgttagtttgcctctccttgcctagaaagggcactggtgagacccgccctaacaatatttcaatattatggttccacagtccagcattaactgtattttaaaataataatatctctcacatagggcagcattttatggattattgagcctatgacaaaaatgttgtattatccttcagatgatcagaaaaactacccttagggctgggtgcagtggctcacacctgtaattccagcactttgggaggcaagggaggaagatggcttgaggccaggagtttgaggcaagcctgaaacacagtgagacctccatctctacaaaaaattttaaaaattagctagacatggtggtgcacacctgtaatcccagctattcaggaggatcatttatgcccaggaagttgatgctgcagtgaaccatgatcatgccactgcactctagcctgggctacagagcaaaactctgtctcagagtaagaaaagctaccacatgaataaaagatctcagtgtcaccaaagtccactcctgccagcatcccttccccgctgccctgagtttaaaaagagcaatacttcccaaacctgtctctgatcaaaggaatccccaagggcttcctgagaacaaccacaaaatgactgattcccagactttccagaactgaatgtctaggataaggctcaggatctaaattattaacaaatactcccaggtgaatgggcttgattggccaaatttgggagaataatggaatactgaagaaagcaggtgagagggctgcctgtgtacagtgttgtcattgagttgatgatagcttgttggaaaatacctgtctttctggaaagtatatatagtgacacccacaccctcatctaacaaacagtgcagcccaggataagcacgatcatatgtgcaaagtgctccacgattagtgaaagaagatacaaggtgatattattatctgtgctgacttcgtcatcctgggcatcagcgtcagggtcatcatctgttatctctcaaaatacatacaagattttaagtagagcagcttgctcgtctctgagaagaaaatcaagtatcacatctacctttgtggatgtgggagggagggaatttgggaaatgtttagtaattgcattctttttgtcttcttggacacagtaccaagtctccttaaactaataaaagaaaaaaaaaaaataaaagaaccacacaaactgcattcttcagtcactccctttctccacaaagtgcttcccacccatttcagccttaaaaaatattctaggcatactcagaaatacagtgactgtggtggggcaaaatgttgaaaattcctttgaggctcatttcccaaattttactagttggatgttacactgaattatttaactctaaataaatagggagtgcactcacagcgtcgtttcttttgttatatcaaaaagcctctctcaaaaaatgctttaaaaatcagttggatatattattaatactaatattaataaaagttaacatttactgacatttgaaatgtaccaaacactctagatgagtaatctttttaaaccttatgatatccaaagaggtagacaccgttgctattcctgcttcatagatgcaaaactgggctagacaagttgaataatttgattaagatacataggtagaaaattacaaagtacggattgactcagagggagaatgtcaagtcctctcctaaaatgtactggcatgtacacacatacacaagctgctggatgtgctggtcctcaaaagttattccctagggacatctctcttcttttttttctctctccttccctccctctctctctctctttctttttcttttttcttttgagaacagaaaacaaatctataccatctattcctgaatgtatatgagtggagggtaggacaagaggagggataagatctgtggatgcacagaaactctttgggaaaccctaaaaactctctatagttatataagctaaggaaaggattcctgccagggggtataggattcttcaattcccacacttctcttcctgactcttctgaagtgcccgttgtcaccagagtgcccaggggcagagcattgacaaggaaaggcccaggtgtgtgtgagaagtcaggcagatggggtgtttcggaggaaccagggtaacgcagtgcttcagcgttagcactcaccttgcttctgggaccacttaccacgaaggcctgaaagggcaggccccaactactgggaatattaatcttctctttgggtgaagtctcttcatgccattatcatctcttagctaccattgctaggcaaaagtttcctagctcaccatgtcctgaatgcacttccttgagatatttctgatgcttaaatatccagtgctttctagtgtgccgtcttccttctgtatttttgttttgttttgttttgtttttttgtggttccttttcagcactgttggtcctgtggaagtatttctaattgactgtattctatatgccacacaaaacagatgggtgtttatgacattcttttctggatatgtttctgatgtttgcatattgaacacagaactgtccacatagagaacttgatttctgcctcttcctggctttgcttttactcatttagtccctagtatgtgaaaggctatgcttaggctccaaggacccaaggatgaataaaatacctccagtaagcttcaggaccattactctagaggtttgtggaacttaaaaagctaaaatgtgttctgttgaatgacaaaaagcattaagttaatagaaaacagagggcttataagtgaatggataaatgaataagtaaaataaagaagagagaaaggaagggagagaggaagaatggagcagatgcaggtgagattgtttttctaaagagctaagaagctgcctacagtgttagcttagagactgaaaatggtttgggaaaataattcagaaatttagggaatacttcacagcatgagaaagtggagggctgagattggtaaaagaagacatgtttcaaaatagccaaaaggaaaatagaaaagaactggtcgtgaaaccgagacctcagagttgaatgacaagtaagatacctctgaagtcactgacagtggactgactgttatttgactaatattgcttctacagagacagacctaggttttatcctcccatagaaaaaaatctcaaacattggtaggttttgtttttgtgttttgacatacaagtcaaaatctatgtgaaggaggaggaacaagactcaggggtcagaaaattggggtttcgtggctggctgtcctgctcacccactttacgtgtgaccttagaaaagtcacgccgatgtgttagatcttttctgttaaaatgtggtgggtaataattataccttcctaattttgaggaattacatgagataatctgtgtaaaaaaattagcacggtgtctgggacatagtaaatgtcaggtcttatttaaaagcatgtggaaagtgcttaatatgttgaaaagtattataaactaccaataaatattattatattattcaattactgttgatcctcaaaacagccatctctggaaactgtgcaattatttgagccctgatgccattgctgaaagcattttggaagtggctttagagaccatttacagaccatataagacacacacataccaaaaagcaataagcaatctcactggtttatagtaacacttcacttatgaccaaaaatattatttccaatatgattaccaaccctattcaccagacagaatgtcaaattagcttagatggggctaactccagaaatgaaaccattctcaagggattttaaagagttttttaagaagtatcacatggacttttaaggcaattccaagacagggagccctaaaatcattacaatgatggcaatgtgtggaataagcatataaacacattttcccagatgcaactttgaaggagacaaaatctgaattctaggcagtttgtgaaggaaaaggagcaatttctgggaaatttcttttacccctcagccaacctcaagacagtctgtctttctacagaccctcccttgctgtttctctttactggaaactgttgagggtactggaaataaaggagaaggccaatgtatctaagaccagtggatcagagaggagcccaagaaccttcatcatttccacagaaagggcagcagaggaaattaacctggccttttgtcatgctattatttctcagtgagtctattaaattattgtggcacactaaacagtgttgtctgcatcttgttctttggggattccatacaattctccccttggctggcttatcacctccccttagaaaatggtgtctcagcaatgatcctttgcttgcaatacaaaaaaaccaactctgctcattaatgcaaaattcttagtggaagaatataggaagaattctgaattccctgagaattagtggggcgacaggtggtggtgggggtgctggaggacgaggtttgaaggaatcagtgcatctttacagtgctagaaggctacaaatcaaggggaaagtctcatggcaggagtagtcgagtgagatccccacaactgttcttagtttctttgtcattatttcaagagtcaaacagcagtgaagggatctaatttgtcttgtttgcgtcctgggccttggctaaaagagaacaggcaggtggcttcagttctaccaaactatgttataaaatgtggtagtaagagctgaatgatgggaccagattttgtgggttcatattctagcactacgacttacagatgcttgtgctcaaacaattcatttaaccttccagagcctgaaattcctcacttttgaagtaagcacaataataatatttatctcatagggagttcatgaaaattatttgaggagatatttatgaaaggctgggcatggttgctcacgcctgtaattccagcattttgggaggctgaggcgggcagatcacctgaggtcaggagtttgagaccagcctggccaacatggtgaaaccctgtctctactaaaaacacaaaaaaattagccagacatggtgttgcacacctgtaatcccagctccttgggaggctgaggtaggagaatcacttgaacctgggaggcagaggttgcagtaagctgagatcgtgccactgcactccagcctggataacagaggaagactctgtcttaggaaaaaaaaagatatttatgaaaaatgaagcaaaatgcatggctcacagtaagcacttgatcattgctggttaactattattaagattatctaatagggatacaaagtatattcctgaaagaaattagggtgctcttagataggggaaataaatgctagtaggattggtttcaatgcactatttattttattaatttatttctcactgaatttctttttatgatactcattttttttagagatccagatggtacctgtcattaatgtatcctgagaactcagttcctctgaaggcacaaaaataatttgaccatctcatcatttgatccacacacatttattgatgcctcttttatgcttggttctatacaagacgccgtgacgtgtggcccctgtaggaagtcctggcctctgtctctaaatctgtcatctcagcccaacccctattcagattatctgtgccctctgcgtagccattcacttcgcctgggtgcaatcatgccttccttacccaacgtttaacaagtccagcctagcaacctacatcatgccatccaacagaaggaaggcattattgactcagaacaaagtataggcgctcttagaataagtttattaaatcatttttttaaaaaaaagatatgtgctttttcccaggggagcagtgaggcattgtcagagggtggattcattaaatcaatacagagaatcctggctgcactatttgttagctatttgactttgggaaagttattctctgagccttgatttctcattagaagacgggaataatagcaaacctatctcagagcattaagtaagaattaaatgaagtgaattaagcacgaaacctagcatctgacgcatagtaggaactaaaaaagaaatactagttcttgaataaacatttttttcttgactgtactgtgatacttccatcagtgagtttccaaggcaaatgaatcatctttagaattggaagctcaatgtaagcaacaatgaagtaaagaaaacaactgaatttctcttgaaattattttcctttactgacttgtctttattgtctgtgttcacaagaaactagctctgactgcaaaaatgtctgcctgtttctatggccagttcttttctacatgtttaaattcctaattgtgcacacaatcttagtcacaatattttcatgtgcaagcaattaagactcatttaacagccctccctctggaaggttttgttctccatctgccacaaatcagattccttaggaagatatttgattttgaaacaatgttaaagtactgttcattttgttcaaatttcatttatgtaccattttttaaagtgatgtaaatggacagccacaaaaagctcagcagctggtcaaaacaaaacatcaaagtcaccattgaaatggggcaaaaaaattaaaaactaatatgctgggacaatgccaaataaaaacgatagtctgataaacattcctcagacacattttgctcataacaactatttcctttacagcagatttaaaatatgggaaaataggaatataccccagttgccactctgaatcttagctgtcctgagttcactgcaatgtatataataaggaagtcagaaggtggaaaagaggaaaagattaaatttgtaagttttttgaaagatatatggtaaaaagtagaggtatccaacagatttgtacgatagattgttcatttaaggaccaggagcggtggctcacgcctgttatccagcattttgggaggccaaggaggggcggatcacctgaggtcaggagttcgagaccagcctggccaacatggagaaaccccgtctctattaaaaatacaaaattagccaggcgtggtggcacatgcctgtaatcccggctactcgggagactgaggcaggagaatcgcttgaacctgggaggcagaggttgtggtgagctgagatcgcgccattgcacttcagcctaggcaaaaagtgaaactgtctcaaaaaaaaaaaaaaaaagattgttcatttaaaaatcaattcgattggccaggcacggtggctcacacctgtaatcccacagcactttgggtggccgaggcaggcggatcgattgaggccaggagttcaagatcagcctgggcaacatggtgaaacccccgtctctactgaaaaaaaaaaaaaaaagtagccaggcatggaggcatggtggcacatgcctgtaatcccagctacttgggaagctgaggcacgaaaatggcttgaacccgggaggcagaggtgagatcatgccactgtactccaacctgggtgacagagcaagactctgcctcgaagaaaaaaaaaaaatcaattagataagtgagagtgtatattcagggcaacttaaatctatgctctcagattaaaaataagatttaattacaattttttttttttttgatgcagggtctcactttttgctcaggctagattgcggtggcacaatcacagctcactgcagcctcgacctcctgggctcaagcaatcctcccacctcatcctcctgtctacctgggactacaggcacatagcactgcaccaccatacctggctaatttttaatttttttttttttttttagagacaggatctcacgatgttgcccaggctagtcttgcactcctgggctcaagtgattctcctgccttggcctcccaaagtgctgggattacaggtgtgggccatcacacccagccaattttgaagtatttaatttttaaaatgaaaaattgattagataatagttctccctcactacaggtgaagtctgtttttatttatttgttcaatgggcttctttagaacatgacatagaaggcaatccttggtcaaattaaggcagaaacaagaatttattaggttctgaacataaataactgtctgtgaactggtaactctctaattaagcataaatgtgaaaagaagaggattagctcttcttgaggagttggaaatggaaaatattacaatttggagaggtagcttgcagaaaccgtacagttttctctgcttatatgccccagcgttgggagacttgaaaggaatcaccaaccaagttaatgcaataaatttccatatatagatcaattggatgttttgtccccagcttcctaggcctttaataaactgaattgttttggtatcactggatgaaaggttctgtaaaagttcaaagtattgttatttggggcattcacacctgcatgtttaaaatgcctttgtgcagaatgtagtccaatctgctttcaaatcagaccttcaaagaagggtagattcatccatgtgacagatccccttaggtgcttctctaaaagaaaaagttaagctagcaggtctacccccactcattatctttgtctctttgtgcgtaatcatcaaaccgcacctctgaaaagaagaccaagagaaaactttagtatctctttgctggagatgcaaagcaagatatagaaggaactggaaaatagttcttaagtaaatacagggggaaaacggaaattgagaggacgtacttttcgctaacagttgtaaactaaaaataaaatttgaagcacgcctgcaccctcacctgaatggacttcctccttggccagggcactttaaaatttaacctgaaagactgatttaggccgcaaaggaagtcagacatgccttattttacccctccagtattaacatcaccacagaccttaagtctgataagaaacatttaggatctcttttcttggaagcctgctacctggaggcttcatctgcctaataaacctttggtctccacaacttttatcttaacccagacattcctttctactgataataactctttcaaccaattgctaatcagaatatgttgaaatctacctgtgacctcgaagccctcccccaactttgagttttcccgctttccagctttccagatagaaccagtgtaaatcttacatgtattgattgatgtattatttcttcctaaaatgtacaaaaacaagctgtagcctgaccaccttgggcacatgtcttcaggaccacctgaggcagtgtcacacgtgcatccttaactttggcaaaatacactttctaaactgattgagacctgtctcagatattttgggctaacacaatgaatatgaaaaaacttttttgttggcgggggtgggaggtgggacggagtctctctctgttgcccaggctggagtgcaatggcgcaattcggctcactgcaacctccacctcctggattcaagtgattctcctgcctcagcctcctgagtagctgggattacaggcacacgtcaccatgcctggctaatttttgcatttttagtagagacagggtttcaccatgttggtcaggctggtcttgaactcctgacctcatgatccacccatctcggcctcccaaagtgctgggattacaggcgtgagccaccacacccggccaaaaacaactatttttaaagagcatctaagctcagaaatcacaggcatattacgcctgccactaagggagttagttccattgaaggatataattaagagtgaaatgaatggtgtgctaagcacttagggatagtggttcacaaatttgtctgttccttaaaatcaccttggggggcaggcgtggtgcctcacacctgtaatcccagcactttagcaggtcaaggccagaggatcacttgaggccaagagttccagactagcctgggcagcgcagtgagatcctgtttctacagaagataataataatcacctggaaatttcttttttttaatgcagctaatgaaggaaaaaaaaatccgaggttttgaaaccaactcaaagacaacagcgatattcaagcataagatgtaataaaggttgtacactagatagctagatagccagaataaaaaggaagagatagttacaaaaaatataaggaggataaatgtataggatttcataactgctaatcatatgattttactgagtaggtgtaaaatgcttctgataatgtgtgaaaatttataatccttcgtattatatgtaggataaacataggttaagacctggattctaaggctgaatttaaggctagtttatctccatccttagatttcctacatttcatttaagagaaaatgtcctgtatattgaatattcatgaaaatctctgaaaggtgttatgcttattcttaacctcttaaaggtgtacactgaatgtaattaaatcatttttgctggctctggttcctcatgaacatctgcttttgtacttccctgtcattcacaaatgcacttaggagctaatgatctatgaggacttttttttcccctacagtaacgagcagcaaatctggctgcactttaatttctcatctgctgtcccatattgtctggtggtcagttcatgatgttactaagcttggctttattggcatcttttgtgagctgctgctgctttttccttggcaaacctgattaccaagctattgcattgagcataaaataaaggtaaattaattcaaaataaaagtgaaggttgagggcaattcatttctgaggtagacctttaggatatgagatgcataaagtgaacaagatcctacaagtgtttacttgacttttctgggttcttttcacctacttactgattttgaatagtataaattcctggataattaatctggataagtaagtcgtcactgtacctctagagaaaataaaatcaaccaaaatatgtttaattctgtgctctgggtttcaagaaaacaaaaatgaataagatatagtcctacccccaaggacttgacacaatataattgtacatgtgcaaaagaaactgtctaggtgtggtggctcacacctctaatcgcagcactttgggaggctgaggcaggaggatcacttgagcctaggaatttcagaccagcctgggcaacatgatgaaaccttttctctacaaaaaaaaaatacaaaaattagccaggcatggtggcacatgcctgtagtcctagctactgggggagttgagataggagggttgcttgagcccaagaggtctaggctgcaatgagctatgatcacagcactccagcctgggcaaaaaatcttaagtagtctcaggactgtaccacagagtatcgtaagaattcagaggaggcaaagaccaaattagaataataagcaatgaaggcttccagcaaacatggtatttttgttgggccttgaacactctttagatgctttagtttaatgtgccatagtcacactttctgtattgggagtgttaatgggtgataactactccagagctttaggattgcttccagtatcccagcaaagcagcccttttcaactagaaccgtttgctattacaaaagagaggtgatcacttgtgatttcttaacatttcttcactttgcctctggcactgggcttctgaaagtccaggaaagagcaatgacctcagggttttaagaccaggggtataatcccagctctgcctagctctctgtgtaatttttggtcagtaatttaacctgggttgtgttctgtaaaatgatgatattggattaaatagtacctaatcatctaactttttcctaatattttattattataaaaaaatgcatgcctctgatgaattgcctttatcttctttagtcatatttccctaagaagtgaataaaagataccaaggcaatgtgtgaattccactttttccaatctggatgtttaggggatatccttgacaccatttgctattttgagttttcaacaaagagttaaaagaaaattctggcactcctatctagtcatcctctccagttggcagaagtcttcatgtggacttgatggttgcccagagcaacaaaatattagggacagaaacatgttcagggactcgattgtataagtgactcagagctgagagaccttttccagcttgactgcagcccatacttagctaaagtgggtatttgtctattcctgtctgcatactgtgacttggagatgcctattattttgcttgctaaaatatggaagccaaccttgaaactggcagagaagagttaaatgatcagaaggcaatcgtcttcattcagcacgtctgacacatgaaagatcattaggactagcaaatataaacaagatcagggagtggtcttgggctttgaagagcacataccaagaacatcaagagaactcaatataaattcaatataaaagctactattcaaggccaattatctcttttgagttagaagagcccaatggagagccactcacgcaaatcaataccctttccttctctcagttggagccagacatctctaactatcctctgaattaaactggatttttaaaatgtttttctgtccctaaactctttaaatcctgaggtcatcctttctttgttccatcagtctggctccatgataccaattactccagcttgttaaagcagttattggcatatggtagtcatgtcttttgtttctatgcaatgtttcctggagcaagaattggagggagaagtattagccaagtcttgttgctttaagtctcctctcttcaactgtttaactaggttccatcctaattatgtgtttggttggttttattttgatacccaatatacattcttctcatttgtacatgaacaatgtcattatggtaataataacaattatacaatattactttctgtcctcattgaatgtcattatgatcaggagctggtcctcttggtttggacattataatttgaaatgaatattctttttaaatgattggaaacttagtcgtaaattcaagtggtttacaatagtaactcttatcccagtaaccacagcacctgtttagaaaaatgtcttcggatcacttgtttgcaaatgtctttttccttaggatcctggatggaattgaacccatatacgttacttgacatgtgaaacacgtgtgaccctggcagatgatttggctgaccttgaaaactacagctgtttagtcactttgaaaacaatgcaatacaagtgatttactaggcttcagttttaaccattttatgctgactggtggaaattctaacccttcagaaagaaaaaaaaattgtgaagcaatggaaatgtaccatcctgggtattaatgtcattaattttcaatacattttctcacaaaaagtataaagaagtctttgcttgaccttacgggaaaaaacaacatacatgtggctttattttgcctttttttttttttaattaatgaagaaatccaagatttgacttttgtttcttctctacccaaatcaaaagcagtctataatctcctgcaaagatcaaagctttttgcttactataaagtatgtgccctgcttaggcattacatggtagaaagatagcattctgttccaagaaatctctattcgttctctagttgctgtgtatatattctcttttagctagaatatggttagtaaatgagtcctgaaaatttcgctgtatataccaaaacatgttgtataccataaatatataaaatatttttatttcaattttttaaaattgtgcttcaatcaagacagaagttgatttctttttccagaaattcagagtgagcagtccagggctgctgtggctgctctaaaatcaccaagggcccagagcttctttcagataatttttttaacatttctagattataggctttgtcttcatggtctgagatgactacaagagccctagccatcacaactaagtggccagcagcaagaaggaggaaaaaagaaggaatagtacacccactccttttagaaaaggcttctgagaaatcccacataatgcttctacttacatctccttggctcaaatttagtgtctgccacaaaagagaataagacacacacacacacacacacacacacacacacacacacacacacatatatatatattttttttttttctggcaagtctctagttcagggatttcaatctcctttaagcaaatgagtcttctcctaacctctccctctggcctgcccagtctctctcgaatctcttgccatcctgtcctccttactcactttgggaaaatccagctctgtcagttttacagtctgccttttccacttccttacctgaattcctgggaaaaataatcccacatcacttcaagctggaattccaacaaagtcaagacctgtcacctcatcggactctcagagcacttgacagttagttcctgctgtgcccctctctcagtcctcttcatgctaattccaaacctgtcctctctcttaagcctcccaaaccagcagctcttcatctcctttcagcaaataacttgttgctttttgaagaaagtctgtgtcaaggcatgaacttcctcagctcctacatcctcttgccatagatgttatccataggtctcttactgacatccataatcccttcctcccttctggtctcagcggatgacgtttcccttctccctcctgctctaagtcaacccctgcatctgggcccttgatcctctctcctcccagctcccacaagtccttgcttcgtctgttttcctttctatctctcacatcttcaatctttacttttattctggctctttccccattcatgtctctcacaatcttaaaaacaatacacagcaaaccacagcaaagttcagccaactctttattgatcctttagctagttcttgatcttctcttttcagtcaagttgctctacctcctcatccctattcagtctgcagtccactgtagtacgactttctcacaacacctctgttccagctgccctcccttggttgccaatgaactcctaattgtcttcttagttcttagaggcttcttcttcttaaactctttctttgttcatttactgagtaaatatttattcaacatgtttttgttgggagccattttgttccagatgtttccacactcttcttgctgctctgaatacttcttttcactattcttcatggtctctcttcctccccactttacctcttaaatgtgagtattctagaatgttctttttgattaattggttttctcactctgtgtactctgtagatgttttcatgtacctcatagttgtattttccatcttatgaaagtgggtcccaaaactctgtctctactcagagtaggcacttccccaatttccaaatttattcacacaaaagcccaatgtccattgatatccaactcttcaaatccaatatgtccagagctggactcacatatttctttgcaaatctgttcttcctatctcagttagtgaaacacttttagccaagatcgaaacttataaatcatgaatccttctaccaaatctatctgtctgtctatatatatttttgaaacagagttgtctcactctgttgcccaggatggagtgcagtggcaagatttaagctcactgtaacctccacctcctgggttcaagcaattcttgtgcctcagcctcccaagtagctggtattacaggtgtacaccatcacacccagctaatttttgtatttttagtagagacagcgtttcactatgttggccaggctggtctcgaattcttggcctcaagtgatcctcctgccttggcctccaaagtgctgaggttacaggtgtgagccaccatgctcggccccaaatgaatacaatttttattttattttataactattgatcaaatccatgctctcttctctaacctgctaatatttccctagttcaagcactcaccaactctcccctgaattatagtactagtacctgaaatagtgtttttgaaactgtcagttgcatttagcattttattttaaaaatatgatacagaattgcgtaaaaaataagagtataaaaccacatctataatatcaaagataaatatggttttataaaattattgatacacccacagacatgcaaacacacacagacattttgccatgaaaatgtatttcttactataatttttaaaattagagaactactttcttaaatggtcgatctctgttgcacctcttcttagctctggccttccatgatgccagcaaatttatgtagttgaaaaattaatctgcaaatgtcactcttcttaaaaccttttcaagccttcccatcatccatgataaaatcagatctctttcgtgtggtacccaaagcccctatccagatatgtattgtacctcctctccagcccagcccctggctgactctttcagcagcaaactttttccacccacgtgcaccatgtttcacaactgtcttcatttacttgtactcttctcaccatctaaaactcgcttctctctcataattgcctggttcactttatctcattttagaggacacctaaaattcaagcccagtccccttcctcaggccgagtcaggctcttctcccaaacctacctctagcataacctaatgaaattgctctaaaaattatggtctatgcctctttattaaaaaaaaacaacaacaacaaaaaaaaaaaccctgcccaccagtatagcaattcttttgttataaccacacatagtactagtgtgtggttctggggcactgtcatgccaacttacctgtgttcaatagacctgaagtagggaagatcagctgactcttttacatctcttctcagaacatcttgaaatgattcttgggtgcaatataagagcaaaacatggaacagtagaaaccagcatggaaaactttttctcctatttgagaaagtgggatgaaaatgtgtctcttaatccctttggcagaagggagtaacttgaaagaagtggatgatggatgatcttctccactctgtcagccctctgagcagaatgaggaaaatgtgagaagcgataccattgctatatttgtttcattgaccattattttaaataacttacatggtcctgaacaaggacatgtttttgtgaaaaggacaacatttcttttggtgtgtccgagtagcatttaagaaaagccttatagtggtcaatgaaggttggcctttcacccgctgctactggagagtctgtgagaacactatttattcagcctcatggaaacactagggagtcatgcctgggatctgacaactgtgcagcaccatgccaggtgcacagagagttgttgtgatgaatgtcgagagaggtggtgggggatttttgttgtttttgctccttccattttctttccctctgacttgggctgtggtttcattcattctacctccccacccctatgcaagaatagatctctgatctctttctcatactttatctgccctaacttccactttccttttcttgagaggagaagaacaactccacagtgctttccttttatgttttgggctaattttgttgtgttgttttatggtcttgaactgagagctgcctcagcactcaacaccagcccctggactgtgagactaatgagaaaagcaaaatgacttcaagtaaaaggaagtggtttgtgttgtggagagaaacttggaaagaaacaccaccaagaacactaggggctttattttccctaaagcctacagttgggttaacacatttcaaaataaccggtcaatttagttaatcccatcaaacgacctagtcaatacagtaaagaggtagggcaaataaacaaaccgttttttggatgaccggtttagcttcatgtatccttcgtcttactcatttctagggaataatttcaactcaaggaaatgtgaacatctgttttgcaaactattacaggctggtttaatacaaaaatacctttaaaaaaggtatgttcatactcaacatgtttttccagctgttattaaagcaggtagaaacaatatagtaggcatagaaatcttgattataatgtggaaaaactaaggttaaaattattagcagaaatacatttcttttccatccttccactgtctgaacatctctctttcctacttcctccattttattattttctttgctttgtttctctcttttaacctcaataataacaattctgtgtgccaaacactgtgctaagactgggcatgcatgatcacataaggtaggtaaaattattattcccattttacagaagaagaaactgaggctcagagaatttagggatatgtcccatggtcattattctggaaagctgtggagccaggcttcaaaacttggcagttatatttcagattccacaccctgcagtcaacactctgctgcctccctcaaattttatctcagttcatttgttttctccgatcttctccttttcacatgttctctactctattctcttgcctttttcctttccttatatctgcctcttctttttccagtctcttccctcactccttcccttatttgtcttgtttcccattctttgtctaaatctcctcttttctctccctcttcaccctattcattcccagctccctaaaattatatcattcttccttcatcatgctccctcattcctcactgcagcatcacccagtccaactctgtcccatctgtgattcctcacttctgctttcgcaccatctctctccctaaggtagaagtggtgcccagctttaaacacaaggcaaagtgagggtatgttccactaggacagcgtgtgtcactctgctgccatacacagggagtaccatcagtgattataaagaggaatttcattcctgccagagagctcacaaattaggttattgttgatgttcatatagtttttagtgactggaaaaagataatgcctccttctatggtcactaccaggaagtgagctccatgcagcagacagaaaccaaccagataactgtgagatcccagccaagcacaatttctacatgttagtcaattgcaagaaacactgagatgtaatgtagtactttggactcatattactcaggtgactatgttttcaagcagccagtacaggacagaagagattcatttccttgaatcaaagctatttggtgacttttcctggaaacactctgaggcttacaggaagggattccagattcccaagctactggcacagagtaagcatcttttctttacatagtaattcacaaacgtccctcatcaccatatgacaatatcctcactggatcagctcggttaccagaaataactagatcaaaataaatgtcattctcacatggacacaggtggactagggtttagaagttttgggaaccatcacagttctaggcacctgaaacttcttcttttgcttgtagtaaatatggtgtctttctcaggactctgccctttgtttatttatatatctggtctggtttttgttttctagagatagttctctactctccatagtgtctgctttctcattgcctgagtttgtacatggcttgccatagcttctctaggcccaattttaggccatcagtagatttaaaaatttttttttctcttgacaccaattaccttagttgcaatttcccatttataattgcaacttgagcctacaaatttacaaatacaatgaggtaactttccactgtggttaaatattatagattattggctgctggtaaacccatgaattgcctgcctttggattagatattcagaccaggtccatttaacaattcagacatttttttaaacaatacttttttgagagtcttccatgtgccaggccctaatcaaagctcttgagatacattgatgaccaaaaagaagcattatccccattcttactccttataatctagggtccaggacaggggagatatgcactgtattaatgaaataatctgtactgaatgtaaaattccaaactgaagcattttatatgaaggaaacattctataagaatggaagcccagaagtccagtctacacatgctcctggaattttatgggaaaataaaaagtctgtcagaatggatcttttgagaagattccagaagtatgttggccaataagagaaaatgagcaagtggatgccagaagccatttcttccattgttgtgctcagtttgcagtgatactactgcagagcttgaaaggcaagtactggcttctcttcctcttgttcttccacccagaaaaaccatccttatcctcatattcctcctccaccttcaccaccactactacctattttgaggctgccaccaccacactataacatattcctccccgctctaaggctctgaatttggacctcccacatgacaggactctaaataatgactaatccattaagtttctgctccatttccaaaatattcattcaaatttgaaatgcctggggcctcttgtgtagccatggctgggctaatttctgcatttgcattttaaacaccctgaatcaggattacacctgaagactttcaaataagtgcttagatggcacaataaagatattcaggttaaaaaaaaatctaatgagtctgttgttcctttgcaaggcctagtgataggaacctcttcttggaaatatttgttaagccattctcacttgtagtcactcttggtaccaaatctgttgaccgaaaaaaaaaaaaaaaaaaaaaaaactcgaggagagagggagaaaggcaaagttactctaatgttttaactaacccatataaccacggagaaccagccctaggaaccaacactaaaatcttaaggactgttttttcagactctgaaaattctcctaaatctccattccagtatcattcaagctctttacaaccgctgtttgtccttaggctgtaacttgtgcctgaaatcccactctaaggttcccttgtggtatttttaatagtgtttgatgctgcagccagcttctctgcggtttgggagttaaatgggatacagcaatgtggtgtgctgtaatggctcttggagaaatgttagggcaaattaaattccaaataggatagcacctgaaagaacctggtcctttagtgaaagagcgtaggaaggaaggcttagagagtcttactggctcctaagtgattaagaagaaacatctaacctgagtttgaaattcattttggactcaaatacagagtatttactttaagacactggtccttaaccacctggttcttccctgtttgcttttctgcttagttaagcccaaagatgggtgttagtttaagagaaaatggtactaaaagggaggaggggaataattaacacctttgcttaaagcaccaaatcccatgagctgatgattgcctaggttaggcaatgactactaccactactaccaaacaggtctggcatctcctattcctatcctgacacccaggcccaagctgagcacaagcattgcaggattccgcagcctaatgtccgtcagcttttcctttgaacagtggttacatatcgttagtgtatttgagtcaaatgtgggtttaaggtagtggaaagacttttttctgctattgagaacagaatcaattttttaaaatgtgtatgtacacacacagatacacacacacacacacacacacacacacacacacacaccgctatatattttattttggaaaacagttttatttccagtagatctttattgaataacctatcatctacggagttcctatttaaaagttttcattggtaatggatttattccagacaggacaggttatatgtaaaatacaattcgtaaccaattaaaacaataacaaataacttgtgctgagtggttaccatgcaggtgctgggatacgctttctctctacatcatcatttcaccctctccacactgtttgaggtgtggatctattgtcattgtctccatgctataaatgagatgaggcacagatgttttttattatctccatgaaacaaatgagagcactgaagcttagagaaggagagaaacaacaacttgaaggtttagatactgtttgaggagttatagtaaaaagaaaaatgaaaagtcctctcaagttccactgaaaatcttataagtgtgtttctttcccacttttgcaatataatttttctcttctaccctcaactgaaataaggtcacacagcctatacagtatagaaccaggactccaaggtcactgacaacaaagtaaaagtcagcagttttggaaaatacatattttttttttcctagctgaggatgggttaccttcattagtgacataactatgtcacttgaatatcaattattggcttgaatatcaattcatttctctattaagaaaaagaggaaataactcagatataaatgatggaagtggctactgagttaggaaaacatttgaaaatcactttataccaagaaatcacattctggcaggcctaatatggtataggagatattcgtaactggttatcttcattgaaagattatagagactagagaataggaaggttaagtaaaaactctacaaatgataaaattttatgttaacaagtaacctaaccaaatactgtatttcgctggactttattgtagacaaacagaaattctggcaaaagaaaaacaacaaaaaataggaaatacagttactaagttaaagctcttgcatttacattataagtatttctaaatccagtttaagattgtggaaacaacaacagaagtatatgaaattctaaatgccatttaattaaagtgttgaaagagtagagatttcaacagtatcaaaacttgtgatcttcaaggatcaaagtaaaggtgagtttatagaatgctcactctaggttctgatttggccaattcaatcacaccactgcccaattcaatgaaaaatataggcaactttgtcaagcaatgaattttatcaatgtattcaaagttgaatgcatcttaggaataatttgagggtttagaaaatgtttgaggttttttttaaaaaaaatcttccaatttaactgaaaactcttgtatttcctttctacttttcaaatatagcctttgtcctttaccctccattgtagcttaagatgtggtcttgcattataaggaatatttaaaaccattcaatattttaaaccaaagacattcaatttttaaaatttaaatggaactgccatgtattcttgagtgttgtagctatacagcagtggtccccaacctttttggcaccagggactggcttcatggaagacaatttttccatggatggtggggagaggggttggttttgggatgaaaccacctcagatcatcaggcattagattctcataaggagtgcacaacctagatgcctcgcatgcacagttcacaataggattcacagtcccactgatctgacaggagataaagctcaggtggtaatgctcgcttgcctgctgctcacttcctgctgtgccaccaggttcctaacaggccatggaccggaagcagtctgtggcttggaggttggggatccctgctatatgggccagaaatgtgaaagaggtgttcagtggggagtatacttctaacttgaatacattcttttcagcatttctacttattttatcaaaaggtaattttttttctcaggaaataaagcaataggcaattgttttttatagtttttctgtacagagccttattcaattatactaccaatgtaatcctattgcactgctcaacagaatcagaataagaagaacttccaagtacaatttgaaaataaaagtatctttcaagaatttgcactgtactgcattatttgatttggaaaaaaaaaaaaatcagaccacttccatttcttgatgaaacaactaactcatttgctaactttcaactggctctcttcagtggctttgagaatgtggcacttccatcataccttgcctgtagtaccaccctagaactttttttaattgaaaatattttaaaagataattgattcgtatgcttcaaaattcaaaacgtgccctagaaaggatcgattattaacagcttcttgtgtattatgtaaacaaatcttatgcatatacaagcaaaatacatattggctagcactcttaaaaacataggaagggttgaatctgaccaagttaatatttcaaaggtgtctatcagaaaggaaaaggaaagcttcctacagttatgtgtatatttttttttagtttaaaaagaataagaacaagatattgggtgtgtatgtatatatgtatctatttatttattggagacggaatcttgctctgtcacccaggctggagtgcagtggcaggatctcagctcactgcaacctccacctcccaggttcaagcgattctcctgccttagcctcccgagtagctgggactacaggcgtatgtcatcacgcccagctaatttttgtatttttagtagggacagggtttcaccatgttggccaggctggtttcaaactcctgaactcgggtgatccacccacctcagcctcacaaagtgctgggattacaggcatgagccactgcgcccagccagattttgggtttttaaacctattgaacttatctttggatacatattttaagttttccttaactgtaaatgtgtttatgttcactagaaacaccacatgatttcgcagacatggaattatgtaggtgaaatcagcggctttcaattagggctcgataatattagatatagtataacttttatggcattcacacatactcttcagggataccctttgcaattccggaatagtgtttttcttgcttacttcagtcgatttcttatatctttaggaaagatctgcacattcattctaggtgaatgtaaaattgcattttaaatccattcattgggaatctcacttcttaaaaatcatgcggaaagatagatgtacatttttagtaaccgagctgttcagtaaatttcttaagattattttctcataacctctgtacatcaaaagtgaaaagaacctgtccccttctctctgtatgcaaaattccagagaagcaccaagaaccagaagaagatgaaagattcggaagagcacacattttccagcctgccagcctgggtttaatttcactttcccaaatatttacttggtaaattcagaaaaatcactggacctccaggaacctcatttccattactgtcatgtgggatagtgataacactatggatcattacaaatattaaattagactgtatggagaatgctccaaaagctaaattattgagtgctcacaaaaagcattcaacaaatacacctttccagttgaaaatgatcattccattaaattcaccctttattttctttgagaaaaaaaatctatgttctgcattttcaaacttacttttcatggatacatagtctgtaataaaaacagcatattaaacatacctttaaaagaacaaagacatttataaaacaataacaacaatcagcttctggatggttcccccccccccccccattaaaccctattaaagggaatacggtctctaaaagggaaatccagagacctgtgtattcgagttataaccctgggtcaagcaacttaactaggctgatattttggcttgatgtgatttatatgtaaccttttaagcaatgtatattaaatccgtactttttactcatctacttgattgcaagctcctgcaagataaactttgttgaactcaaatgttgtaaacttcatggggcttagatataaactacagacttcatcagtgtttaacaaatacttgcttaagaaacacaaagtcctgttatatcagccaattaactatgaagctaattttaataactgaaatatcatagaggttaatattcaaaacaccactcatcttttttctcattgagtattatttatttatttttgctttctggagacatacgtttaccctttatttactgtctcattttgtcatctctgaacataccatttacagctttttagttattctggaaaaatcactttgtatgaaataataggctatgatggctagaaaggatctcactgatcatcagtgcaaggattgattttagaaacaaggaaagtgaaaccagagacagccagtgactagtctcagtactcagagaggtcatggttggtcagaggtcagaactcacatctcctgacccacagcacgtttggctttgtgcacaactgactgccttagttaaggacagataattcttttctctttaacaatagaaaattagactaattaaagtcataaaagatgttgctcctttataagccatagagaaacccccgatggtttctttatttggatctgtgatctttaaagcatgtgactagcagctataattggattaaagtgaaaacatgtgattgtgaaggagttaaagtacctttgccttattctgctttgatagccagcttcaattgcacatcgtgacaagcagtgaaccaacatcaaccctgtggaattaaaactttagactctatcacaagcttttccaagttcaaagcccaccaatttattattggttccaagttctaggtctagaatcaagtcagctgggacatcaaatacttgttacaaaatgacatttgaatgagataattataaatagcactagaagcacatgaattaaatattgcctgaacactaattttcttaggtaggatattgggatgtcctttgctttatcactttgcagtgatgtgagcagtatgagatactatgttttgcaaaactgtattaattataatatttattgagtacttactatgtcccatgcacagtccaagtttttcatgtacatattattatttaaccttcactgctatgcttgcagatggatgtgtggtatattttagttaactcgctcaaggacatgcacagtaagcggtgcagctgaagtccagactgggtcaggctgactccacaacctcttaatccctatattaaattgatatatctgcccatgctatacatctacttgatctttaggttgatttattgatagtgacatttaatttttgttttcttcaaaattaaattcttactgtaaaactagtcaaggcaactgaagtttgtgtttgaataaaagtgtagagttaactgaggatttgtgtattctcattccaagatgagaagggagggagggaaggaagaaagaaggaaaagagggagggaaggaggaagggagggagggaaggagggaggaagggaaggaggaagggatggaggcaggaagtaagggaaggaaggaaggaaggaaagaaggaaacagtaaaggaaaagaaaggaaataaaaagtaacttcattcctctatagaatctctattaataaatgttattttttaaaaataaaaatacagttatttttcatgaatataaattttagaacatatttttcagtgctccttacctaactcccaaataatccattacttacatttctttttttgagatggagtctcgctctgtcacccaggctggagtgcagtggcacgatctcggctcactgaaacctctgcctcctgctttcaagcgattctcctgcctcagcctcccgagtagctgggactacaggcgtgtgccaccacgcctggctaatttgttgtatttttagtagagatggggtttcactcgatctcctaacctcatgatccgcccgcctgggcctcccaaagtgctgggattacaggcatgagccactgtgaccagcccatttcattctttataaccattatgaattcccacctagtttgagaaccactacttttgtgtggtttccaccctttgtgtgatttcaaaaaggctcgcctttaggcaaaatttagcaagaagtcaagccaatcaataattgcttgaagtcaacttttccagaataaaactgtataagggactttgaatttgaaggttacaatctaaagtttgctttgagatgggaataatacgtagtgttggggattattgtaaacctaagtgatctaattggaaattagaattgaaagtgggaaagtgaaggaggaaaaaatgaaggttggggagaaaagaaagcaatttaggagactctatagggaggaaaggatgagatgcatttcagaaacaaaatattaacgtaaacagaaaaaagagaaagcaatcatgacaaagcctaagagggctagtggaatgctagaatgaactcatttaccttcctttgatatttaggggctctattgcctgctaatttcatcactgttatttttcttacctcttatctttttccctgtagttattatcagcctaatattcattcattcattcatttacctgagttttcaggcttgtgcagagacaacagggtggggccaggttgcaagattgtgttcccaacttggaagtaacgtgggtaaggaaaaagtcacagctggccttagaagacacaagttaaccacatcccatgggtcagtggaagaaaacaagggaataattagaaaactgtgcaagatcagaagggagcccctgaagctataactgcaagaacctccagaccctattgcctttaaatccccttttaaaaggcaccaagtgaggaaaattccaagatgaatgggttacgggtctgaccttcaggaacatgtaggctgcctgccgatgtccacaacatcgtccctttcacatgcctaatacattagcgtgggccactcatttaaaatttaaaaaatttcatttagcatttaaaaattcatttgacagaagagatgtttcaaataaatagtcttcaaaaaaagcccggtctataagtctctgtaacacagcccatctgctttaggtgaagtgaggcagtaggcctggagcctcacctggttggctcttaaccacatttactttccaggagaagcctttcaccaacttcctcagaacctccaaaacaccaaggaacaagatcctgaaattgtccatagtcttaactttgttaataacagactgcatgcccctggaaaaactatttcacttctcttggcctcatcaacaaaacaaatgtggcctaaaatactttgtaagatggtttcagttgtaaacagcctgaaaactcttagtacaactaatttgggcaagtaggtttggctacagataaagaacagaaagacttagacagtggtatacattactctgaaatatttttattatgtaagtacaaataaatggatgtctaattgttacttttcaggtagcaacatttgtaggaaatgcattttgttaggaattttaaaatcactgaacagattgccatttagtttacattttcttctcacctgcagatcctgaaacctctgaacttttcttctgccacataagtcaaatatccatttatagtttttaactcttctctttggcccctaaaaatagaagatcattcctgattttaaaagtagcacttgtatgcatatatataatttttatctttaaaggaatacgctgatgattcctgactctagccagtcctttgcaaccttcaaaggattgtctccttggccctaagatgtaacattgttaaccttttatgacagaatcacgtcaaggaatattacatctcttctagttcctgtaccatatctttatgataagaatgtgtgcttgccatctcaaaatattgaccctctggtacaatcacttgtatctacttgaatacagatgtcttgttactatttctggaaaatattcagtaacaaatttttctctgaaatattgttattaaattttcttaaaaattgtttctaaccttctttactagagctcactataaggtagtctttagtttaagaacttcaacactctctgattttggtttaccattttcatttgtgcaaaatgaatgtgtacataagaatctgtatttccaacccaaagaggcattataatgaccgttaaattttccatccaagaaataaactaactccaccatccctgagtgtataccctgcccttctcactcttgtgttctttaattagacccaatgtgcaggacatgacttgactgaaatttatagccacattgagacatgcagctaaagaaagctcttagaccaggcatcatctcaaacttttaaagcaataggatcatttgacagaagtgtgactcgctatagtaattacacaggtgcaagttataactacttaatctgctcccagcatctctgttgcccttgagaagtatgatgtcctctagccaacatggctgttcatatgggactgaatctgcacatatttgaattgagtttttcaagtttagaaatgtgatactattttacccttatgtgccttccacaatcctactcctctcttaggtggatcagagtttctggaatccatcatctttagttctgcaatttacatctcagacttacatgtttctaggcataaatgcaagaatgacaacatcaaggcctatgaaacttagacttgtatgtatgtgatggtagacattgaagtttgttgcaggaaaatgtttctctgtcatcctaggaaaagcccccagtttctcagttcctcctcctccacacgacagttttttagtttttttagttttttagtttttttctaaaatggagttaagtccaggtgcaatagctcacacctgtaatcctagtattttgggaggctgagatgggcagattgcttgagcccaggagtttgagaccagcctggacaacatggcaaaaccccatctctaccaaaaataaaaataaaaaaaataaaaaaattggcatggcagtaggttccagtagtcccagctacttgggaggcagagcctgggaggttgagactgcagtgagccgtgattgctccactgcactccagcctaggcgacagtgagaccctgtctcaaaataaaatccaattatgatcatacctctctcctgttgatgtccatcagagtctgcaatgccttcagggtaaagtttaaacttccttctagaaacaatgttctgcggtaaaatgaccagggtctttggtattagatacacctggcctcaaaaaatgggtcagcccaggtataaccttccccatcttctgtttcctcatctgcataatggagtaacaaacattgtcaggaagttactggagtaattgtgtgagataccaaacataaaaagcctggcacaaaataaaagctcagtaaatgtaaatgtcctgtcttttgcctttccctcattgtctgcgacttacctttctaggttcctttctcccatgtgcatccccttccttccaaagcactcattgattctagcctgcagtgtatagtttcctgatcaagccaagctctcccacacctctgtaacttttgcgtatattgttcagtctccctgtaagtcttccctaccttcaccttttatagaaactgcagggtacctacttgccccttgagatagctattcctgaatttctcccgaatttaagcattcctcctctatactttcataaatctttcacacacctctttcatcctacaatgtcataatattagttggttttatctgtcttccttaatgtatccttaactcctgagagtggacgctacatcttagtcatctatgaaaccccagaaaatgtaatcaagctaaaatggctcactcatttcctagcaaatattggttaaatgactgaatggatgatacagggggcaaaataaatatggttttagaaaagtggcatggctgctgatctatcagtgcaaaaaggagcacacccacccactacatggccaaaaatgttgaaggcaagagactagatggcttgtgaataatatcaaatgaagttgtctttctgtaggaagtcttagacaatgtaatcttgggaggcgggtggatcacaaggtcaggagttcgagactagcctgactaatatggtgaaaccccatctctactcaaaatacaaaaatagccaggtgtggtggcatgcacctgtagtcccagctactcaggaggctgaggcaggagaatcacttgagcccaggaggcagaggttgcagtgagctgagctcgtgccactgcactccagcctgggcaacacagcgagattccgtctaaaaaaaacaaaccaaaaaaagaaaatgtaatcaagctaaaatggctttggctttccttcagtaaatggttactgtgggaatatatgtgaaatgaatatcaatactatgatgagaaacacatgcactaaacagctatacttctgatgccattctcaaatctgaaactttgcccaatttcagggacaaaagtgaagtaatatgtatccccagtgtttagcttttctcttgccatggatactaacagtgagattcctcagggactgttcctttaacctcgttagggttgctaggggctattgtgcctttcacaacacagcacctgcaactgggaataattgaaattttctgccattagctattcccagcagagtattctgagtcacatagaaagtgtcagaagcatataaattactgatacattttttaatcccatattccctcagggttggcgtttttctctcttgaaagtttcccccttaaggctgggcgtggtggcttacgcctgtaatcccagcactttgggaggccgaggcaggcagatcaagaagtcaggagatccagaccatcctggttaatacggtgaaaccctgtctctactaaaaatacaaaaaattagccacgcgtggtggcgggcgcctgtagtcccagctactagggaggctgaggcaggagaatggcgtgaacccgggaggcggagcttgcagcgagctgagatctcgccactgcactccagcctgggcgacagagcgagactccatctcaagaaaaaaaaaaaaaaaagaaactttccctcttaaaatattcttgtttaaatctaaattaatttcatagataccatttccatttttctaatgaataatactgtatcctttcctatctataccatgaagtttttctttgccttgaaaacccatttagatttatgatttctagcccccaaaataacttttgttcctatatccaattccttccctcacagttctttcacaatagcttcttttctcctgtaaaaccctacataaactccaaaaacatttctagttttggaaatcctaatccaagaggtcacatcactaacgcaaacgtagaaatctttgtaccaaaggacagaggtgcaagggaagtcgggagttgtggctgtgggaaagtgaggaggactctttggcatctgggcagaggtacagggaagccaggatgggggcagaaagaaagtttctcagtttctcttgtgtctacggttcatgcttaggcctctgcagcagccccaaggcaggtgagggtgatcagctgttccagtttgcctggcactgagggatttcctgggatgtggggcattcagtgctaaaactggggaagtcttggacaaattaggacaagttggtcaccctacctttcccttgctgctgctgtccttttaaagtcctcattcctttgaaaattgcagtgatcttcagttcttcgtgattttaactgtatacaaatattcaaagagcttggaccagcacatttctcagagagagctctacttacagtaaatgttatgtgacagagcaggatagcaaatagatgttacctggggcaactctaattgcttggtcatgactgtcgggagtaaagtgttaatagtttcttgcatatcctccaagagagtattacaaatactattctgcaccaagctctttgtaatttaatagtgtatcttggggcccttttgtatggacttatacagatcatgatctagagataatgatcattcttatttgacacatagtattgcattatgttatgtctaaaaacccatttaactctattgatagtcttgtgggtcatttccagtttttactacaattaatacaaataacactgcaggcatccttgtgcctgaacatctttgtgagtttacccattgaataaagtcttagctgtgaaactgaatttaaaattttcataaatattgccaagctgtcttctaaaaagaatatattaagttacaatcccaccatcatcacaagaaatgcttgtatttctatacacactgaccctgagattcacaaaaaacatattttccccatctaatttaattgcaaagaaaattagtcacctttcatacatttatgggccagttccctcctacctccaaagactcattgaatcaattatcttgaggagtttattttttatggatatgttaatgttttgagtatattaagaaaatgaactctcctcatttgtgtaaacttttcaaaaaattttaatttgtttagggttttttttttttatcatttagtcttttaaaatatttgagtagtcaaattcatcctttcagatggtttctggacaccctgtatcttttatgcttgtttttcctggcattcggtgcagtacctatcacaaaatagattctcaataaatgttttttaaataaatggacaacgaatgcatgaataagtgaaggatataatttattcttttcattcctcctcatgctatgtagagatttgcaaaatgaatgccaaaacatatctttgaacagaatttcatggcccagtatcttcaggcagtggtttttctgttttgttcaaaatgatgtccctatcatctgcatagtgctggcgtatgggagatatacgtattgaatgaatacataaatatagagaataatgagataaatagaacgtggattatttggagttcatcctcctgagctaatgatgggcatttctggaagtgctgggttgcaaataagtccagaccagagaggattgtgtttaaaggcccagaatctcaactgataatcctcagaagctcagatttacttttttcattccaagtaaattaaactggagtggtaagaaaaagaaaaatggttatgaccatcaaccccagaaacagggaccacatttaattgaatttataatgtccctaacatctctgctgtgtttgaaaggttaaaaatttcctagagaaaacagcttttgctactacttgccaaagtactcataaaatggactgattgctaagaacagaaaacaaaccaaatcaaaataaaatgaaccaaaaagcaacagaaataaatgtgccttaatgtagttggatgattaccacatctactctcctcagaccaccagccttcagagtaagggcacatccttccaaataagtgcatccttgtcagggacatttggtgaggtgcaaccccttcaatgtgtccgtttcctgggtcatttggggtcttaggaaaatcttcttgttggtgcgcactgaattgcacatgcattatgtaactcattgcaacccaatagctgaactcatggtttcatagctattaaaatatgccacaaaccaaaccacctgtgaggcgccaactcagcaaatgtgccttttcagaaagtagtcataaaaggtacaaaaaatgaggatgaaagaaccctgaataacaacctagagctcatacatttggagccatgaggaaaagtattccatgtaagttgaaggaagatagcagtcaggagcattggtgttgaagaccaccctcactatgagaaagggtcatatatataatgtggaatgaatcagagctaccactgtgggtcccctgttggaaaaactgcaattttggataattatgtgcaagcactaggagaaatgccagatgttagaatccatgtttaatgtgaaaattgcattttgttgtttgcagaacctcaatatatagctttctctataaaatgtgggcatatttctgaaggaaagaaaaatgccagggtttcgttttaacatcctgttacgttttagttaaattcaaaggaacatgacttttcaaagagaaaactgtctctctctcataaaatagcattaagtggttccaaacatatcttaggttataattgaaattggactctgtggaacaaaattaatgatggtttgttctcaaaggcccattgtcccgttgattttatcagttattctttgttaataaggtggtaatgtggtcttaagagcttccactactgagagaatccaaggaatcatagataagtaaattgatgtcaaatattatgactttttctctttcattcttgtactgtatctagttgcctcatctttttttctaaatctcacagtttttgatcaaattccctagggacagcttacatgctagctttatgagggaggtgagtcatgcaatcccaagaaagcaaaagtggagttgagggggtgaaaggaacagcagtagggaagaagagaaaccatgtacaaggtaatgcattactaagcttgtcagagcttcccaacaacaacaacaacaacaacaacaacaaaactagttgctaagttacaagggacattgcctgtgaggctgtgtcgtaaaacattccacatggagaagaaagggtgagcaatttttctgtgcataggtcttttgtctctcattggtcaaagtttgctccatggtacccttggccctcccagagtccctggggaatacagagcctttgtccatctcacgtgtagctggatggttcctgtcaagtcagaggccattgcccacgctaagcccgcaaggatggggaggtggaaaacatgaggcaattgcagtgataaccgctgctttactggggctgctgtggcatgcctgggaaactgggagagtggcttatgcccaaggggtagggtgggcagagctgacctggggaggccacaaacaggacctagtgtacttttctacagtatactagcagaattagaatgaatcagacaagagatttattaaattaagcttttgtaatgtcctgatgtagtgcactgtattttaatgctgtgtcttctgttgcttgagttcctaatttgtaccaggtgttgtgccaaatgcttcaaataaattaccttgtgaaatcctcacgactctatggactccaatttacaaatgagaaaactaagacttaacttgcttatcttcaccaagctaggaagtggcagagttaaaatttgaatccaggtctaaagccattggtcttctatgccatagaatcggcatccattttgctactcttactagaaaatcatgaatcctagctatgaattgtagtgaggaggaaagttttttctgtttcatgtttatgaaaaaatctctacctttttcattttgtgtttcatgcatgtgacagcattttcagagattttgtgtaagagtgtgtgtatatatatattgtatatttacagacagaaaaaaattgagattaatttttcaattctctaagtcataagagaatggaaaaacagaaatggacaagcagaattttttatcccaatgtattctttgacatacactggtcataatgctaatgttagcaaaagaaataaagaaatccctggtgcaatgggatgattgaccttcctttagcagaacagtgttgacttgttaccgttgtcaaatcagactgaacacattcaacaacatgatcatttctacttgtgggtttggactgacaaggacatttctagtatatcttgttgacatcaggttaataagctctaagcaaagctgaaaatgaatgctacttcccacaatcaagtggaaatgttaatattatcaacatgtcttaaaggccatgaagtcctatgcctgtatatgtaacaggaatagcaaacaggaacttttcttaaagggaagattaaactagtgttatttttatgtattcgttaattgcatgctccccatttttaaaactgtacctgaaaatatactgtaataaaaaattaaatttgaaatattataccattgaataaggtcctctggatagttttgagatttaatattctttatttcaatttacatgtatactgaatcacgtaaaagttatttaggtcagtacttccccacatttgttccttcatgacatacgctgataactatatttctacgaaaactgcagtaaataaaggatgtggcttgtgttcagtctcccacccactagcgacaagagccaagggaaatcaatagcttggctcacctgtcatctccactctttggcacaccattgagaagtctaatatgtgcaaagaaaagttaattttactttcaagggttatacctttgcttattccaaagaacggtgggggagtgtaccagggccattattataatgtatattattaaactttttacattttaactgatttctcttatagtaaaattaattatatattagctttggggtatacaaaattgcactttgataataatatttaggaattggcaactttgtgggcaaagttgtgggaactatcagaaaagtaaaaaataaaggtgggacccgaaagaaggaaggattgtaggttggagccatacgcgactagaaactaagacatgtatccttaaaaaccctcaaatctgtgttctgatgggaaaaccctgctaagtcaatggttcccagactttggaatttcaaaacaaaaaactgtgaggcccaacatacaattaccaactcttcatttttgccaaacaaaactattttcaacagaacacactaacatatactggaaccatgatttcatattatgacatttattttccacattctatatacttttaatatgcaaaacaaggacaaaaagggcagtcatctcccatggggggcttagaaatctctcattaatgtgtgtgtgtgtgtgtgtgtgtgtgtgtgtgtgtgtgtgtgtgtgtgttttaaattggccttattatttctttaaatttaaccaagggccagtaaaactcccttttggaataccacacgcccgtgctgttcaggaatgattatgataaagtcattcatgaggacatagagttatttcatatgctctcaaaaatgacttgcagtgcgaaacacagctactattggacaagacaacaacccaactttatataacaattttttaattcactagtacttgtgtatcagtcaataaagtacctggtacttgtgtactaggcactgggatggagttggggatacgaaagtgaaaaatatagtcacaatttctaccttatactctagtaggggaaagaaaaacaaaatgtatgattgaactgccttaagcaccatgaaggcaacatacaaattgctgtgagagcatataaccaactcagaaatcagccttaaactgagacctaaaaaggactccccctgtgccttttgtatatttaaggcatcttttttatattctagaaatacaatatcattgagcagatagattccaaagggccatcttctagctggatgaaatagaaaagggcaccccttcctcaggctaacagccctgcctgctgagggcatagttaggtgaatggatcatcactaatgaatggatggttttaaagaagggaataacatgaccaaatttgcatttaactttactcaatagtctggagtatttaaatatgattaaaccttttctttccattcacttgaatgaggcagaagggctattcaggaatttaaagttgactaaggtattgattgggtacaaaatttttactaggtaggtaagggcaggatgattccattagaaacaagaactttttctccagtgctctgggaagaattgattggttcagggctaaatcaccaagatgaataccttcttttgattcacacacccttttgacatctgggtttccctgaatcatatgcaatctaggacttacgcagaccactccagtttcacttacgaaatttgggttagccaacttaaacagtcatggctgtaatttgcttctgagttaaaatgctattattattttatgttatttatggattcctgcaaaggagaaagcatttttattttgataaattttgttattaatgaaattaactcaattttgtagtaacatagtatacagtgaaaatgtgctttacgagatgccgtggcttgtctctcaaatggacaatgaggctttccgaaacctttgtgcctttaagtttaaggaattgatttggcgtcttatctcagtgtacacaaagcttagttatcacctaggaaatattggatgtttgtctcagggagaagagacaatttttgagaccacaattaggttttgtagctatttgacatccaattataatcagatactcagtgaaacatgcattcataatgcaggccaatgatcatatatttggcttagcttttcactagaaaaattctttaaagaaatattgtccttccaattttagtggtactgaggaacagctctggttataaggggggaaatactatatgtcctttgttcaatcttactaatctttattaattttatgattttccccatttattttttaaaaatcattaataaaattatccttgattgagtttctcctatgtgctaggcattgtgataggactttagtaaacatcatctctaaccctttcaataaccctgcaaggtagggtcatattttatagataaggaaactgaggctcagagaagttatgtcttgaaattatatagtagcaagtggttaagccaggtttccaacacaggtttgtctgactctaaaaccagcatctgccccatctcctcaccattcgcgaccagaatgtgatgcacgtctaccaaaaagagagtagcaaaaggtgatttatagaagcagttacagtcctctgaagagaaggcaaaactattggggatagggaaaaagtaactataaagatcatatttatataatcgaatattaacttaatggcttgaattaggtggcaaataaaatatattagcaagcaatgttacaaaccatggtgagagctatgtagtagatgaagcagaatgatggctgggctcagggagctcatacatttggaacccagataaatctttgctccttcttcccagagcccatcatcactttttaaaaacacgtctttgctgggctcagtggcttacatctgtaatctcagcactttgggaggcaaggcaggaggattacttgagcccaggagtttgagaccagcctgggcaacatagggagatgctgtctctacaaaaaataacaaagaacaaaaccatctgaatttcatgcattccaacatatattattttgttccattctacttaataacctttacactagttgtgaaactcactgaaaacaaaggagaaactcattataattcatctaaacattcctgaaatatcactttaatcaaaaaattaagaaatattgctcagatttaaaagaaaaatggaaactcccttggcaagtgggtttgaggtttggtcattaggttttgaataatcaggagctatgtgttgtagtaggaaaagcataccatttagagagagacagctttagtttgtcagtcctgcctcttaataggtggatgaccttgagtaaagcatgacgcagcctttgggcatcagtttcctcacttaaaggtagaagggttgaaccaggtgtaagctgctgttcttccatgttatgattctaaatagttctagatggaattatgttgcacatttcatatgttgttaaacagcttctctctggaacagttgctcctaatctcctaataagcttactatgggtcactcagcaatcttcaagagaaacaaacattatttggttggtggataccaagacaattctgatgtgtttgtgtcaaagattggtcagatgaaatctaactagacatgtatcattccatcatcaagcgaaatgaccttgactctaaacatcttaatttgaactgtagacatttcccaaatgctttagggtagatttggaccataatacactccactgtaaatggagaaagttcatcatccccataataattgcccccaaactgctaggtaggaatgcatactgggtttagtatgtattaactcccttgtgaattcagcttttgagagcagacctcttaacaagtcatgagtatttagagtgaaatatttaattcttagtgatactattttcctattctgctattattattcagctatgattattttccttctcctcccaacctcctatttctttttctttattaaaaaaaggagaggaggtgcatgctgccatctggggtgaatatgggcttcacgtggggacctgggcgctggttctgatccagagagtgagctaggagcacttacacaagagggtcttagccactgtgtcgggggaatagccttatatcaaagactgaagccttttagtaaaacctgaagaataatcagaagcagcattgactagtctctaaccttggttgagggacacacacacacacacacacacacacacacacacacacggctctgaaagctcagacacggaggacacgctgtgatccacttagccctctcttctccttcagggggtccttgcaggacagaacgctaaggaacaaagtcttaactggcaagctgccggcagaaggagactgtctggtggattgcagcgctgattaggaacggggagtcctttgcgtttcagaatccggtccacattttgctgagagcccaggcactgtgaataagaggagcctctgaggactggtttctgatgtcgcactaggcatgataagaatgccattgacgtcagcagagtcatcatcagggagaatggcaccccagctcttgaaaccacaccaagcaattgcagtgcttttgaaaattaaaagccggtgctggagtgtggggggtgaggtggggggtgggggggtggggagggaaagaagcaaagagggaagtcgtggctccagctgaactcttctttcttctatgcgtttcctgtattttaaaaaggcaggctcacggccctcctgtgcacacgcccgctcactcacacacactgctgcctgggctcattaacctaaattgggggaggtgggggaagaagaaagagagaaagaaggaaaaaaattaattctgttaacacttctgcatgcacataaaacaaactgtgccacccaggtgctggacagaggccctgagccacataagcctctgagaatcaaattgctgaggtaaaactgatatgctttaaatgtgtgttgatgaagagattacaagggaggaattaaacacttcaaaggagctactacaaagcaacaatcactcttcccccatccctcacacacgcacattactgtggacgcttgcatgtttgtgtgtctgcctgagaaaatggcaaagttggtttaggaagggaacactgcaggcatgttgtgatttcagctttcacaggcagctccaagaacatcacctccagctataattcaacggttacctggactggaaaatgtcttggaggttacgaagtctttgaattctttagtgtaaattgtctccgctttgaaattccacaattgatcgaatcctttcattctctttcccactcctaattgttccactctaactctccacccaccgccaggaatatgaaaacaacatagagtagaactgatgatatcagctgtataacacgctttattttacggcattaatgggcagctttccaagtccataaaaatcttttgctgatctgattttaatatccatattcttcagttatactagaaagaatgatttccgagatgtggaaatgttagccgggaaacaaaaggacataggcacataaagcaaaatctggcaggaaatgtgggtttaataaattgaattatgtgaaactcctatttcaaatggactgatactagaggagcagccctcgagagatatgcacagtaatgattcttcgttttcaaagacctgtttctttttgaaaaggaagaagccctgaacagcattcctttcaaatacacaaaggtagctaaagtacaaccttctcctctttcctatttgttctttaaaaaattgtaaaaattatattaagtgtgcttcttgtgatagagtcaataaagggagaaggagtttagcaaagcacatttactatatactcttaacccgtcttgcttactgtaataatcgaaagaaagatggctaattgtcttgcaggaatttgggttatcctctgaaaggatacaagtaaatttgtaacttgggtcgtattggctattttttgttctcttttgctttcatttttgttttgtctgaggtttataaatggaacccttctttcctttcttccttttttccttccttccttcttcccttccttttttcctttcttccttgctttctctctctctctctctctctctttttttttttttacaattgtacttaaaagaataaaggattctgaaaatcagttccaggatccaataagggcctagattgtatatcacaggatcagagccccttgctctcaaatttatgattgtgaggatgtattattgtatttgggggatcaataagcagagccagagccttcacacaaggctccttgtgccccctcccccgctccatcccatgaggttaaaaagcactgactttgactttaacactgtgaacaaaatacagaacaactgtttcaattcccttcactatttctgctatgtgcctagattagatgttttctgacctgtctccctaagttgttcctgtcacttgtgtctgtcattcgctcccccatcgcatcctgcccaaccctccctgtctatgattcgaattgctctctgtccagatcatttcctgcagtgaaaaacgaagaaagactttctcccttcttcccacctacacattccttttgtcccccaagatatcccttcctcttgcctggaatcttcccaggccttaattgattgatttaggccccctttgcaccaggcaccctagcggaagcccagaaagccccaagagtctggatgtgttttggagagcaggctcaggttcactgcacactaatttgcagcaggaagtgctaggaagcccgatgagggatgggaattagcaaataaggttggcagtcaattgacagaggaagcttaaggaagaggatcattttgaaaaggaaaaataatttaatccttttcaggtgtgttaatttctttcgtggaccaaattaccatggacctggaatagttgagattttccctaaggtctggctgtacttcatagggaagaagcaagggtaagtgcagtaaatttgattatggacaccagtctaactctagcttaatgagccatggaaacaaaatagctcaatctcttctaactgctgtaatgcaacactaggagcattgagagcactgtggttttggttacacaaatttgtagtacaggccttgcctcagcatttgaacatttcagcaagagagctgaacttgcttcgttcttcatgtagcagatataagtcttttggaattaatttgaaaaaaaaagaaaagaaaagaaaagaaatgtacccagaaagcaagagatcttaaatgtatccaaaacctagaacaaacaaacattaacatttgccataattactgtgggtgtttttaataaaaatatatagatagataattttggaggttgcatttccccaccatcactgccagcctcatttttcttccatcctctccagaacaacctctgccataaatttaggaaatagtcaacctgttcacattttcatctttttactatatatgttcttattcacaaacgaatatgttgtagttataaaaagtcatcagtatcttttagcttatttttttaaatgcaacattatgtttgttggatcattttactcttgtcccagtgcaccctgtaattcccatgaattgacaggtagcgatagatcagcagtagtaaagtaactgatatgggtaggttaatagaatgacccttttaagaagggatctcaaagagggaggctaggtaagctacaaaattatcagggcgaaatgcagtgaggtagaagtgaaagcagcttagagtcagcctgggctaagataaatgaggagtggagctgcagctggaggagcaagagaatatggtctactcgagtataaatcaagcttgctggtgagcagtttaggactagctcctggttttacagcaagactttttatgtgatcttgaccaaaccactgcacttgattgctcctttctactccttggtcctcacgtgtcaaataaaacccctgaattgcagagccaaaatgcaaacaaatagaactcctcactcaacctccctcagtttataagtaaggaaatgaagacctagtaaaacattataacttacagatacctgtcagggcagaaccagaagctggacttgggctaggaaaagttgttcccccctgattacattttccaaaggttataccttttccacagtttctaaggtaacatgttgattgacttgacagttgtagaaatattaggaagtggtataaagccaagaccatgtttactaaacagtgctgctcttttttttacatcatacagatgagaaagctggtgctcagggaatttaagcaacttgcccagagtcacgtagcttagaagtgttagagccaagatttggaccccagtctttctcactttcacagacttgcttttaaccactgtgttatgctatgctgcctcagtataagctcctttcaaacaaaccacttccagtctctgacatgcaagcccagaagttttcagatttacaatggcatactttttttctatctgctaagtgttagatgtcacggtgtctgcaatggagtagagctttagaaatgaggataaaacatttggtttgatgttagtattaagaactccaatatccaaggcaggaaacttggtaattaatattttaaatggactggaggggtcacaggtattaaaatcaatattttgatggcaagataacaatgtaggaacaaataattggagatgtttagcaaaattatgaattaagtagatgtataaacggcagattatgaaagggaaacaaagattacctgggaagagttttgtgttttagtcaactgaattaccagaatgggcagaaaaaggaagtatcaaagaagggtctgctgatagaaaattaaataaagaagaagatgccatggaaacgtttttagtgcaaatacactattgctcatggctgaagacagaaagaagactatgtgtgacttccagatgaagttcaggcatagaggcagggctaaataaacaagcacatagacccgagaattctcgttgattgatctttggaaattcggtataaatatgatcagttcaaccatgccttagctactggatcaaaggagacatctaccggctttgggagataggaatctggaaaattgacagactgaaaaaaccaaaaccaaagaaaaaaaaaaacaaaaaaaacagagaatgcagaatgccattttaaaaaccctaagaggctgtgtctgatgttacaggactctttgactccattagtctcaattctaatatttaagttaagtgattgtgggcatagaatttttttcaaaacctgtttcgaaatgaaggcttcccatacattgaagttaaaagtggtcttgagaaaagaacttcttaataggtaaggggttttactttggaatgttgaaaatgtttggaactagatagaggtggtggttgcacaacattgtaaatgtgctaaatgccactgaattcttgactttactatttttaagtttatgtgatatgaatttcacttcagtaaattatctttgttggtgcataattactgtatatatttatggggttcatgtgatgttttgttacatacacaatatgtataatgatggaatcggggtatttacggtatccatcacctcaagtatttatcatgcctgtgtgtcctctttctagctattttgaaatatgcaatacctgttgttaactctagtcacctaatctgctatggaacattagagcttattctatctgtgtgtttgcacccattaatcaatctcttcatcccctcccctcccacctacacactcctcccaggctctggtatctatcggtctaccttcatgagttcaagttttttagcccctgcatatgtgagaacatgtgatatttatctttctgtgcccagtttatttcacttaacataaagatctccagttccatccatgttgctgtaaatgacgattttattcttttttatggctgaatcatattccattgtgtataccatgttttctttctttcttcctttctttcttgctttttttttttttttttttttttttgagatagagtcttgctctgtcatccaggctggagtgcaatggtgccatctcagctcactgcaacctccgcctcccgggttcaagcaattcttctgcctcagcctcccaagtagctgggactacaggcgagtgccaccatgcccggctaatttttgtattttaagaagagatggggtttcaccatattggccaggctggtctggatctcctgaccacgtgatccgcccgtctcggcctccaaaagtgctgggattgcaggcataagccactgtgcctggccgtataccacattttctttatccattcatctgttgagggacccttaggttgattctccatctttgctattctgtatagtgctgcaataaacttggggatgtaggtatctctttgatacaccaatttcttttcctttggataaatacccagtagtgagattgccggacatagtggttagttctatttttagttttttgagaaatctccatgctggttttcatagtggctgtactaatttacattcccactggtgatatgtaagagttcccttttctctgcatcctagccagcatctgttattttttttttattttttattattttttgcatttttaataatagccctctaactggggtaagatgatatctcattgtggtatcaatttgcatttccttgattattagtgatgttgagcattttttcatattggacatttgtatgtcttcttttgagaaatgcctatttatgtcctttgtccacttttaatgggattgtgtgcttttttactattgagacgtttgagttcctaatatattctgaatattattcccttgtcagatgagtagtttgcaaatattttctcccatttaatagattgtctcttcactctcttgattgtttgctttgctgtgctatacagaaatttttagttcaatacagccccatttatctatttttggtcgtgtggcctgtgcttttgaggttttagccataaaatctttgcctagaccaatgtcctgaagtgtttcttctgtgttttcttctagcagttttatgtttaagtctttaatccatcttgagttgatttttgtatggtgagagataggggtctactttcattcttctgcttatgggtgtccagtttttccagcatcatttattgaagagatctcctttccctaatgtatattcttggtgcctttatagaaaatcaaatgtatctatcattatgctctctgtctactctaaatctatcagtccactctgtaaaaatgtggatttgtttccaggctctctgtattattccattggtctatgtgtctgtttttataccatgttgcttttgttactatagcgttgtaacatatcttgaagtcaggtagtgtgatatattcagctttgttctttttgctcaggattgctttggttagttgtgctttttttttggttccatagaaattttaagtttttttttatttctgtgaaaaatgacattggttttgatagggattgcattgaatctgtagattgctttgagcagtacaataatttttttttttaaagagaaagggagaaagaattgggcactaagtacatcagagtagatgtttatcaatttttttaaaaatggtcttggctaccataaactgtgatgttcttgagagcttacattgtgtcttgttgattttggaattgttgatactcaaagtgcctgacacatagacttgattcatatgtatttaatcaatgaatgaatggataactctgacctcctcttagtgaagtgcacgtcatggggctaccacttgactatatgctgtgggatagatcaaagaaaggtaggacacaaccttgaacaaaattaaagtaaccttcagcttgtttataaaaagtgttctggtggagaaataatgaatcttttcagattttagagtgttgctgatttgatttcaatttgcatttttaaccatcagtctctgtggaactttagtttataggtaggacttttgattgagcttggtggctcacacctgtaatcctggtgcttcgggaggccgatgtaggaggatcacttaaggccaggagtttgagaccagcctggggaacagactctactaagaataaaaaaattagccaagcagagtagtgcatgtctgcagtcccaactacttgggaggctgagcctggaggatcccttgagcccaggagtttgaggttacaatgagccatgatcccaccactgcacactggcctatgcagcagaacaagaccccatctcaaaaagcaatgacacacagaaaaagcagaattttaatttgttctgctcttgtctctagcacttcatatccatttctctgaatatgaacagtgggaaaggtagtggaattgaaatggatcatagaatgtttcctctactgataatttttactccatttggagtatgattgaagagctaatgtcaagatgcacagcaggactcaatgattgaaaaatagtgttactgatgtaaaagtcaccatattttaagctttctttatgatagtcttccattatttcctttgtcatattagcaccactggaaaaacacaagttatacgtagggtagaaaatgtaatgacaatttggtgttttataaacaataataaatcagctttcatgaaattaggctatgtcctctgctctggtgttagaacttacttttgcctgagctcactaaataattatttcaatttcccagataaatgtacttctgtggacagaggccatatgctggtagcccctatacaatatatagagagcataaatttcctcttctctcttggtatttaaaattaggatttttataaaatgcattttattcttattttgcttctccatcattagaaagattcctggatctgtaaaccaaaaataatagtaataataatgataataagattttggcaatttaaagagaaattcactttcgtgaatatggtcacgccagctatcttttgaaccttaaaggaggcaggaagaacatttgaattaagaattttggagtattacaacctcatttggttctcagaagctttttttaatttcatcttctccacgccagtttatacaattctctcatgcctcactttacttttatatcttttcttaaaaacagtttaaattgtatcctccccaccccactttatacaattctctcatgccttactttacttttatattttttcctccattcttccttgtttcattcattcactctcccaagtcctctggcctaagttttatttgtgtggtattaagcagagaccaacagaacaactgtgaagacttcttggggataaaccaggtttcacttgaattgtggtgcgtctgccattggtgtggaagcagggcagaaagaggacagaggcataccagcaagtacagacatctaaacacaaagagaggagaacaacctcagggatactccctcagtgcctgggaagaaagcaaaacttaaagtgctcatagaattgtaaataaactctctcctctttgaaatttatgttcgatggttgctgtgtagttgcaacagtgtcataaagtccatgaggcctattttttttgagtaatcaatattgtggaaaagtgctagagcagacctaccttatataaattaatttgtttgaattgctctattcactatgaataaatatttattggagtaccttctatatgctggggacctcagccatgagatacgcaggtggaaaaaataacacttaagcagcttattgtatagcagagaggtggttgaattgatagacaattaaaatacaacgtgttgaaaggcctgttaaagccacagggtcactcagtggcaggagggattcagtcagcctgggccagccatggcaagtaagtggcctttggaaagttaccaaggtaagacatacctgatacgttcaagaaacaattccaaggttcaataaggccagaagttaaagggcaatgtaagccctggaaactgaggctagaaaggtagaaggatctctttttaccacacactgtgccgggcaccatgaagaatacaaaatagctagctattatggagcctacactttaatgtgtgtacatagatacatgtccatgttggaatttaactccttgagaggtcatgaattacttagtcccggaagcatttgaatttatactggaaagctatagtagagagttgacaaaatattttaaatgtagtaagaagaatttgacaatctattgtgtggtatgctagcaagccagttctccttcctccttttctcaccatcccaccacccctcacaaaaaaaaaaaaaaagttaaaaacctgatctgcagtgtttgtctatggccatggtgcaaatactcctcccatggctggttccaagctaccactggttcaacagttcttttgcagaattcttgaatctttaacacttaacaagatccagttccagcatattcctgcaacagcgattctgcagttctcaatgtcaaataatagaaccaaaaagtcatataagtactacaaagaagaagagagagttgagagccagcttagccaggaaatgctccagggggaagtaaggcttgagttgggacttatagataagaaatgtaaataaaaaggaacaaacactcccaccgtgatgcacaaatattggatcatgtatgtgtgtgacaagtgtggccgtctgtagtggagggtccaggtaaaatttaggccatgaaagccttggtctgtcaaactaatacattttgttacattaaagttagtagacagccattaatggtttttaaaaacagatggtcatagcaatgttttgacaaaagcaatttttaaggaagattttgtttttataaaaagttgaattattgatagcagtgagaccccagaatagaataagagacctgcctcatgtaagtgagagtaattcaattcagcagtaatcttggaaatttgtaacttctgtggtgagaaattgtatcctgggatgttgggtaaagccactgtgaagccaaagaaattagtggctaaacgtagagaaattaagatgaaggaactggcacatggagccactgtgtactataaagtatttttattggtatttagtcttgctgttattgttgctaatgattgtattgaataattaccagctgttgttagttatttgaaattaggtgcctaaagcaacctctcatcttgcagaaagtcatctttcttgaaactttttaaaaacttgcttgaaacatggagacttggaatgggacgtctatcatagtagcacatctgaaatccttctcattcctgctgtcatttctgtcctttcgcagtccactttgtcaccacccccaccattccttgttctgcctgcaatccagctttccagtcactttctctacttcttgcctggctgcagcgtcatcatttaaacagctctgggttggtatctcctttcaccagaattcctgcagccgtggagtacgtgcagagcatcttccttttgaccctcttaaaatgctgaggggtgtttccgacacacattgctttgtaattcaataatagggcagttgtgggttctttttattgcagttatgctgatttttaaaagcactctgagtaagaaaggaaaggtagtaaaatatacgtgtacctcgatgctcattgatcacgtttgcacatgttcttgccaaatgttgtttttaaaacctgtctctgcaggtctgagctgtgaaagtttgggaaatcagggtcagaaggcaaaaaaaattcgtttgtatcatcgtcatacaatataaattacatgtagcatatacatagaaaacaatccaagggatgagcttcctggaaatcattccttcttgtttactctgattatataatggggaattgtatgctttatacaattttaatttcttgaatatatgtgctcaaaaaacattataatgtggttcagtactatatatgctgaaaacaggttgctaatgaatttggacaaagattcccattttatttcctgtacgtttacacattttttggctgtatattatatttactatatatatttattaggactacagcaaacgctaattcatcgactgagataagaaatgtgttttccattaataattataaatctgccagaagattgtgagatttacattgttggggatctaaacaaccaaaatcattgcaaagttattttaaaactattattaattatttatgtaatcatagattatggcttgcagaagactgaagaaattgttcaacaaaccatgtaggttttgtggaagagcagtagactttgataagtaagctcagagtggtccattaaccttttctctatatgtacattatgtgttgataagcatgatatctattatacctcaattattaataacaatatacatcctaactattaagaacttagcctgcaaccctaatagtgtcccctttcttctagaacatagatcagcataaggaaggaagcaaaggaggtctctaagcactcaaaatagatgttcacaatgttcactcactgaagataatgtaggtcattagccagagaaatgtatgttcatattttagtgatgattcatacaagcttggtcatgtggttctaaaccttctataattggatgaagcaaattaagaaaggctgggtaggagatttcagggaaagtcacaactgatattagccaaatgtcagctgatggcctgaaaacaacaacagaaaaagaaaatctacaaaatcatttgaaaaccacagacatagctatttggggcctttttgaaaggggcaataagctcaacccatctttggaaacactgagcgcatcctgtctggacaactgagtataatttttggtgttcaaactgatgaccccaaatcatcaaaaaatacaaaattatattttgctcaatctgtattgctcttctatattatggtaagatttctgtttagtgcacttaaaagtaagactacccccaaatttaatccccatccccttcaatgtctcctcctggacattgctccatctatcgccccttctccctctttctttgacctactctttgatggctgcatctccttcaaaactggttgaagttcctaaggaaaaaattcccttcctctttgatcctgtatcttccatcagttattaccacatatctctattgattttcgcacccaaacttctagaaagtttacacttatcattttctttttcttttccccccacttattcctctacccccttgaagttagcttgcagccccaccactctgttgcaactactgctgtagttcctctgctctcccaattgccaaaccaagtagatatttttcagttcatttctcatcaagtttctctaagtcaattgccagtgtatccctctcaaaaacctttccatctttgcatgaggtcgtacactctttcttttcctttccccccacccttcctttgacctggggttcccaggatcccattctccattcctgctttcctcactctgtgtgtcttccaagactgacttgtgcattcttattttaattaccacctgtttgctgaaagcccctaaatttatatagaaatccatcttaacctcttctgcaaagcttggaaccccaatatttattggaaattcccaactgagtatcccatgggtttataaaattcttcatatccaaaaccaaatttagcttttcctctaaatttgtgcctccttatatatctcagttggtgacactacccagctatcatgttcagaaaataaaataaaaatacgtcataaaagcatcaaaactctataaatttatccatgtaaggattgccaccattaatatatactttaaatccttccaaatgtttgtatacttgtatatatttaaagggatcatatttggtgacttactgctataacacatttttcccatttaacaaaaaaaaaatttttctgcatcaaagtatacttcaaaattatttttgtagttgctcatgttctagcagttatttaactaataatgttaaacatttacatcatctttgcaactttatttctcttgttgcttttttcttaagaaatgactattgaaaatgacccccaaaagggtatataatatcagtgataaaaattagctcttggaaagggaggagagaattttctagtgtatggtagtagcagtaacagtggcctagttacactcaatatctcaatatgtaatgccatttatggacagcttactatgtgccacactctttaaggactttgcataatcctcaccacaaatctgtgagattggatacattattgttcttatttcatagttgtggaaactgaggcccggaggagtgaaatactaggccagggtcacacaagtagtaagaaacagagccaggagtccacctttggcagtctgtttccaagattggtcacctaacacaatgcttatctgccttttgttgtaccctagggcatcctttctaccagagtgtaccacttcgctttatgtttcttagaataaaaccaataaatagtgcagttagttagctaagttttcagaaattttgatagatagtgtctagagaaacaaaaaagacacaatttctaagatgtagtaatgaatgtttcattcatgtcggtgattattttgatttgttgatgtgtttttgataacagagtaggcaaaaaacataccatcaatttaataatggaatcctaagtttaggtttaacatgatttttgaagaagaatcaatgtgcaaatgttgatgtattttcagagttatggttcagaaatgtgaattattcaaatctcatatcagaatctaaatttttaagaaaggaataatagaatatagtaggtcccctaccatcaattctacttctgtacccctattttatcattcatatttggcttgctagtgaagatgccttgtatctgttgtatcactgggtataatgtctggcatttgcaggtgtgcatgcaaggaaggaaagaaggaagtgagggaaggtggaaggaagagaacaaggagggaagaagggaagggtagacactttgggaggccaaggcggttggatcacctgaggttgggagtttgagaccagcctgaccaacatggagaaaccccatcgctactaaaaatacaaaaattagccatgcgtggtggtgcatgcctgtaatcccagctactcaggaggctgaggcaggagaatcgcttaaatctgggaggcagaggttgtggtgagctgagatcgcgccactgcactccagcctgggcaacaagagcgaaactctgtctcaaaaaaaaaaaaaagaaagaaaaaggaagagaaaaagaaaaaaggaagggaagggtagaaagaagagaggaaggaagggagggagggttgaattatagatttccccaactgcctcccacacaatgtgctctaaccataaattcttcatctcagttgctcaggccaaagcttgagaatatccctgtgtctactctttttagaacatctcgtatctaatacattagaactcctgaagcctctgctctcaaaatatacccagagcccagcatccttgtcaccatctccatggttaccatcctattgcaagccaccatcttctctggcttggatgattgcagtggctgtctaataggagaccctgcatctcctcttgctgcataacagtctattcaaaagacagcagtcagtgcaaatcatgtcattcctctgctcataaccttgcaatggctcccatttccctcagagttaaaagtgattattgtggcccacaacgtgtagcccaatttgacccctgtttcatctctggtcttctttttaactcttctttctctcattcactcagctccagcccattagcctccttgctgatcttcaagcacatcagtcacacttccattttaagaccttggtgctgcatgaagtgctctttcccccggtatcttagggccaattccattgctttaagtctttgcttgtgtttcatctccattaggccatccatgaccatcccattttttaaatgcatcgcacattaataccattcccaatgtctgctctattgtatgtatgagtgcttgtttcatagcatgtctatccttctaacacataatttactatatctattgtttattatctctctcctgtactagactggaaactaccatgtggaacaatcttcgcctattttgttcactgatacagatatatatacacaacagtgcctcagccatgctaggttgctcagtacattcttgaataaatgaattatcgatgtactcagttctgttacacagatgatttggcttctttggtttcccattaagagccttgttttctttgccaaataattgaaagtttcactcagaagataaggaacatcaaagacctcaagctttgtggtcttggaaagctgtggctttggtctctgtctcattccccttgggatttagaatagaaaaatgcaggtggagaacacattcaaacatcccacactttatcagtattttaaaagaaagaaagtatggctttttttttctcaaaacaatgtcttagttataaactgaatttgtataaatggccagttgtacattagggcagttgcacaatagaaagcatccagggaacaatcataacctcaagagcctattggaaagtgggatcctaaatagctttctatgatctccctagaaaactgtagaatttccccagagaataagccagcattttgttgaccattctgcaattccaggatcatgcttgcatagtcatagcttggaaggaggcaaattgaaacaagttgaaaatctgcaggaactatccccagtgagaccacagaaaagccagaagaagaaaaggtgggatttggggtagagaacgagccacttctcactagtttgcatgaagcattgaatatcccaagggagaaaacattgaagttctatgagacaccaagaaaagtgtatagattatcacagcatatggatagaggtcatttgttccctccctccctttaaagaaaagtagctttgcaagccacagtttaggaacaaatggactttttgacatagttcaaatcctcctgggtgtggaggcattgacaggagcaatgtcataaattggttaaaggttgcagtctggaatcaggctgccctgaatcccagccctgccatttactagctgtgagaccttgtgcttcctaacctcagttttcttttcttttcttttttgagactgggtctagctctgatgcccagtctggggtgtagtggcaccatctcagctcactgcagcctctgcctcctggactcaagcgatcttcccacctctgcctctcaagtagctgggactacaggcatgcaccaccatgcctggctaatttttgtatcttttgtaaagatcgggtctcgccatgacacttaggctagtctcaaactcctaggctcaagtgatccacctgcttcagcctcccaaaatgctgggattacaggcatgagccacggtgctcaactaacctcagttttcataatggtaaaataggaataccgatagcacctcccttggtataaggattaaataagataatctacatagtgcttgaaacaatgcctaggcagtgttcatcaacagttagctgtgtgctgtgtacatgctggagctgctaccttgtagaaattttaaatttaaaatggtgtgtagttggaggttaggagttactaggggtatcgcctagggaaagacagttggttacccagacaggtccttacagagtagtgttttccctggagaattaactatattccagaatctgtcctcaaccaagcagtctcagaaaggtgatcttgtcacagcctctgagtaagctgattcaaactctcaaaagctcacaagagccttaaagccagagtatcagctgattccttaaaagctacaaagtgttttggccttgccaacatacgcattctccctcttatgggtaggtttagaatgctaaatagtacataacatggatttagaatagacagatttacatatgatcagaaggctcagtggtcatagttttgagggcctaggacatgcatgtgagcagtagggagatcatcacaggaggatgggcacactctcgaggctcatacaggcgctccctctctccatgggcagcacaaggcaagtctcctttgtctttgatttacttgccaaccaccctcattctaatgggaactttctttttccaaatatgttaacaccttcaagtaattactgtcagcgtccagcctgggagtctcttggacacagtttttcataactctagatggatctcataatttgcccctgaaagatggtaaataattttacttctcttacttctggactctaagggggatacttcactcttgctccttgacctctcctctctagatcccacaagccaaaaattgttggaaaggattaatatgagctgggcccaataggctacagcatgcaccagcccctaaagccagctttaggattgggcggagtgtcagcccagcttccaccccacttggcttattcagcgacctcctgcaattgtcctctgctagcccttggcagatcagaaatgttctaaagattgacctctattactttgggctttccttaacttggcatccatgaaaagatccacttaaatgctccagattcagtgaagtctccttatcagagcttcttatagcacccatacttttctttctcagcatttattatgaatgtaatcaaatcatactttgtgcatgttttgttgtggttgctgtttaatgactattttgtccatgaaagaaggaactgtgtttgttttatcactggtttatccaagggactagaacaatgtatggcacatacaggatttaacgaattttttttaatgattaatgcccctttagatagtgtttttcatctgagtgcctcaacttctatgtgcattatgaaactgatatagtgggtcacaactatcagtaagaaaaaaagaactggaatagagtagaaaaagatgagaatgtatcacgcatagggaataacttttataaatctgtttcagtatggataggcaggcctacaccacacacacacacacacacacacacacacacacacacacacacacacattgagttcctatgaatttgttttttttaatttctttcttttttttttttgagaaggaatctcactctgtcacccaggctggagtgcagtggtgcgatctccactcactactgcaacctctgcctccctggttcaagtgattctcctgcctcagactcccgagtagctgagattacaggcacctgccaccatgcctggctaattttttgtcgttgttgtatttttagtagagatggggttttgccatgttggccaggctggtctagaactcctgacctcaagtgatcggcccgccttggcctctcaaaatgctgggactacgggcgtgagccaccgcacctggccaatattttttaaggtaagaattttgagaaacactgtcctaggttccctctaaaaccgaagatatcaccctatgttcagccttttagccctaatccttttcttaatcttccctatgaccaaatattaccatgcacacatgcacacacatacacacatgtgtgcacatacacatgtacactaatccatctaaagtgctactgttaaggaggagcaatagaagaggtgattcagggaatggtttttgatggttatttacttttataatagtttttatttgtaaaaagaagaaacctagagttttgtatcctaaacaaaatttaggattaggatacaaaataataaaattcaaaataagtcttgactagtgagtgtagaaggacagtgctacatctgaatctccagttgggtttacgcattttgtatttatcaaaaggcagtagtgatttaaaatgttgataaacactcagtttcagttttctattgctgcaaacaaactattccagaaagtgatgtcttgaaacacaaccattctattttgcagtctgtgctgggctcagccgggcagtcctgctggtcttacccatggtccccaatatggctgcagtcactccagtagactggaggctgggcttagctgagatgacctgctttctttctttcttcatgtagtctcatggcttttctctctctccatgtggattcctcatgtgaactctccagcaaggtagtcagaatttcttccctggcaactcagggctgccaagaacacaaaagccaggctttcttaatgtttaagcccagaactggcatgtggccaattttttgtgttctgttggttaaagcaaaccgagtcaagaagagcctacacaagtagtaatattacaagtatgatgaaatatcattctcttcttagaccaaacagcatattcctccctccactcttaccctctataatgttttgcttttgggagttcctttatatgaaatgcctcccctctacttctccttctactgaaatcctactcatcctgaatccagctcagagctaactcagtgatttccttcatacatctctattatctcatcctggaaataatcactcctgccaggtgcagtggctcatgcctgtaatcccagcactttgggaggctgagacaggcagatcactgaaggttgggagttcgagaccagcctggccaacatgatgaaaccccgtctctactaaaaatgcaaaaattagccagacatggtggtgaatgcctgtaatcttagttacttggcaggctgaggcaggagaatcacttgcacctgggaggcggatgttgcgagccaagatcgtgccactgcactccagcctggatgacagagcaagactccagctcaaacaaaaaaaagaaaaaagaaaaagaaaaatgccctcagcactctcatagcattatgtctatatttcatattatgtcttgacatataactttacacacacacacaagcacacacacacacagatgtagcttgcttttagattttaagttgcttatctaagattgggtgatcaataactgtttttttcaaaaaacattaactggttttctatgacttttaaatgacagctctaaataattataatttctcactagtttaaaaaggcaggtggtgggatattcaaaactattggagaaaaaaagctgatgtatgctaccagcataaaacaacaattgccctttacatcttcagaaacccctgtactgtgcagtcattttcaaacctggatttttgtcttgtgttttttccaaagtagtatatatttaactttgtaaaatggtgtggtgttttttggttgttgttgtttttgagatggagtttcattcttgtaccccaggctggagtgcaatggcgcgatctcagctcaccgcaaactccgcctcccgggttcaagcgattctccttcctcagcctcctgagtagctgggattacagtcatgcgccaccacgcccggctgattttgcatttttagcagaggcagggtttcaccatgttggtcaggctggtcttgaactcctgacctcatgatccaactgcctcggcctcccaaagtgctgggattacaagcatgagtcaccacgcccggcctaacatggtggtttttttcctacctaatatgaagatacttaatgtcttaccttggaaaaatatacatttcaaccagtttatattttacagaagtgactgagaaatcataagcctttgtgcaataacatcatcagtcaaacacataagcagattctaatctgccctctctatcaattagtcttaaaactacaagttgttcctctataccagctacacatgtgcattggtagtcttaaattgtgatatgagcccttaggtagttcacacctttccaaaggaagctcagtgaacttcctgaaactgtgtaaagaattgtgtgtgcagtatgtgcatgtacattatctgtatttttctgggtggatgatccagtatcctcatcagagtcttaagtttgagaaacccaattatatattagttgtaaatctgtttactttcttagaattcttctcacattaaaactaagattatatttctatttcataggtaaccaatttcttctggagcaactggacacttacacgaacacttccatctgtctttcatctttacattttatttctaggtattactagtgttaggtcacactccctcctatggggagattctctatcacatctctagaacttcaccaatgcaagccttcttaaattgacccactcgctactgagtctgacccctgggccagtcacatcggtgcttgttagaaatcagaatcttggaactaaatcagaatctgcaatttaacaagatttctaggagtttccacagcatatttaaagcttaagaagcacaaagctggtgcatctaataccccactttctgctttttaatcttgcaggatttatgttttaaattctttataatactattaacaattatcatttgatttctattttcatatcatctgacagttttgattaaatcctttaacctcaggatttgtaaggggtaaggggagtgggttaactaactgatctgattatcaaataatgctaccattcaggacttatgcatagtttctgtgattctcaatagaatttgatggtacctacaacctctactccttgttttagtgtctatgtttttccactgtgcttaaaaacatttaaagggagaggctggaaaattattttaagatgaatactataaatgaaataactaagattagaaaaggcaatgataatactgaattacattggaaaaattcagtttacaaaactctgaaaagttcctaaggcagaattttgctgccccggtttctcataatagacccagcagttctaagttaagcacacatctttttggctatatggtgtatataccagactatcctttttctccaaaatttgactttcatctcaaagagtttaaggaatttgtgacttggtgcgtttgatgtggcacagttccacatgtgagggatggtgatttggatagcacgacagaagtacgtgccaagaataattggcttctgtcttgcggaacagctcaaatactatgtgtatcacagtatgtaatttgggtgtacaaaatgcctgtagttcaaagtgctttactcctctgcagtggcaagctgagcttcctgttggctgattccttatgtttgcagtaaacaggctgggtgcagttagaaagaaagcatccatctagtaagtgcattcacatcatccttcaaatgccataggccttagctccaggacattttctgcctgtctccttccctccctcctttctttcttttcctctctccttccctctttcctttgttccttctttcctccctccccttccctccttttcttcctagttccccctttctttcctttcttctattgaataaaacgcaaagtaattctttttctacttactttgattcttatcagctttcttaagcagtttccttgccgctgttgtgaattacatggggctgtggtaaaatgtggcacatttcaaggctatgtatccctttagattctggttcagtaagcttggaaataaataggagagcttacgcttttaactactagcctgcgattcgtataatcatgttagtttgagaaacactacagtaatcacacatgtaagggctttggagtaagatggaccttggttatccaacgcttactgtgtgactttggtaaattacctaaacttttctagccttggattttaatgtgtaaaagatagataatactaactcagtaattctttatgggttccatgagacaatgtatttaaagcacccagcatactatctggttcatagtttacagtcaataaatgttaattccattatttgatcacaatgtaagactattgaggtttaattttgattgttttttcaaaagtttgtaatctgttaggaacaatttctaaagtaaaattcagaaaacaaaaccatcaaaatttaattcagctaacatttttgaggttctatatagtctcgaacatatattatctaattcgattatcactataaaccctgtgtatagtagatattatcattcccattagtggatatgcaaaccacggctgtgggatagttttacatttagtaagtggcagatccaagtctagacagcccaggctggttctctttatactctgcctggcaacatttgccttcatcactgtctgttttcaaaagtaactaacctctacatccctgctcacacatacaaatagctctaaaggtacaaaataaagctaattttctgagcaattcattttattcaaatcagtctaatgatctgttccatgaaaaatgattatgtagctcaaaggtcttcaaactcgtctcaaaccaggggtcaggcagatcatattcacataaagggagaagcttgccagccagaagtcaataaagattcctgggactggggtgacctggaagctacaacctgtttaaaggagacagcttctgcctagctccaggctagtgctcaagtgccaggatgtgggctccctattgtcaaatcttttttttttttgcttttttaagactggaagaaatccaatatttaatgcgaaacttcccatttttgaacaacgtgtgtgggccaaacaagtcacatctgtggaccagatctggcctgaggattgccagtttgcaatcttgacctaattgcccttaattcttcacttctcttgacctggtaaatactccatttaaatgagtattaggtatgttctgggcccttttggactgggtctttgtaatatatacaaatttcaaagactgacctttagtttttcaggttcagaattgattttctcagaacccaattagatcaggtgctgtcactgacactcagaactcatgaactttatgcaagagcaagaacatgaattagggaattcacagtgagaaatatattgacaagtagacaggataccatattggccagatcagttcattctgtccttgtagttcagccccttgagaaacaaacttctaattagaagctgctttgacatatatggagtcagaaactaggaactgtagactttaaagggctttcctgcattgggttttgagattcttcctccttttatggtagtcttaacattcggctgttaagtgttatgctccccctccccaggcatgccaagtatatactgaccaagtgtcttctttatttagctaccatatgagtggttctcaaacccatgcccttgttaaaacacagattacagagccctatgccccacaaattctgattcagtacttctggggtgggtcctgagaattttccttcttataagttcccaagtgatgctgatgctgatgaactgctggatggggaaccccctttgagaagcactgggttcctctatcatcttcagctgacaggctttttcccctttgaagggttaccgctattgtctgtgtctctgctttaatatgctaatatagcattatggtcatatccagatcctgaggttggaacctgggtcttagaacaatttttaaattgtttatatttttaaaggtatttgatttattaaaactatttgattactttatttcatcaagtccaaggtgccattgattataaaaacatgtctggattttagaggcattaaaaatgtaggggccaggcgcgatggctcatgcctgtaaccccagcactttgggaggccgaggcgtgcagatcacctgaggtcgggagtttgagaccagcctgaccaacatggagaaaccccatctctactaaaaataaaaaattagccaggagtagtggcacatgcctgtaatcccagctacttgggaggctgaggcaggagaatcgcttgaacccaagaggcggaggttgtggtaagccgagatcataccattgcactccagcctgggcaacaagagcaaaagtctgtctcaaaaaaaaaaaaaaaaaaaaaagtagggaaaaaattaacagtttcagaggtactgcaaattagtaaataaagcctcagtttggggcagtctcccctggattatgttgtatgtgtgtagctcaactcgatgggcacagttgaaggaaggattccctggtatgtttgttaaacaaacataaggtgaattttaagcctcccttccccaattcttagtggaaaagacactactggtactgtgtcctatggctgactttgtcgtctaattgaaatatcttattattgtatgcatcctctcctacttaaatgtgaccctgaaatgccagatctttcctttggaatgaatcttttttgtcttattggactggtagggctatgcacttaaaaaaaaaaaaaagttgattattagactcactgtttccttggccagtcaggaaaagatatttaggacaagagtttctcaattgtcctcatccagttttgcctttatagtgaatttcaataaatattaccatgcctatgtaagagggtgactggagaggcagaaattctatctgactgtccacttctaactctactattggaaaacctgctaggggtttttgtatttattatttttggaaaaatcattaagtggattcccttagctatataaacataaggcctgtcatctttttctttggagaaagagtgtgacaaaatttcccccttcttattaaaagctacccctcctcttggtacagtttgaggatagcgtggaccaaactacctaagaattcaggagtctaccaggagaaaagagactttctcactttgtcccacaattagaagtactgaggaaacccatgagaatggatgaaaaagggcagtcccatggtgtattgtcgggagagaatgctgatacggcgggccctagagggattaatgtatctgtgtagaggaaggggaaacctaagctgcctgctcaagaagagcatcttagattgttgagtgagggctgatctttactaaatgagttaaatcaaagagccaaactcttggagtccaaggctgggcatggagacccaaaccagcaaggacacaggtctggacaggaccattgttcactgtgataccacatggcagtggcagaagccttcataccaattgccgtcctctctacacctgaagtttagaagcacgactctgctttagactgaataatccctgaggttcttgggttatttgaaagaggggtagttttcaaaaagagagatattagatttcctattgaaagggcagccctggtctccagtgattaactggaaaaacaaaagagatataacaatttttacatctaagtactgtgctagcttctgtggatctagaatcaaatgagacaagatgtagtatgacaagcagttagactctcaagaaaatcattcaagtctgtttaggaaaactgacattcattcattcagcaaactattgagtagctcctgtgcatcagaacctgtattcacagtcaactgaaataaacacaatttctacacgagtggagttttccaaatagactaagatgtcataatggactgtgtgtagagtaatgttcaagttttttttgtttaagcttccccatcccccagaaaatactggatatatatagcaaaacctttcatggataataattgacatataccttggagaccatttggaatctccataaacgaaagaagaaagggcatttcagacaaagggaactacatgtacaaagtcacaggcatgtagaaaaagatgaatgtttcggagtaacttacagtatgtagggcgcaaacagaggaaatggcaaggaataagactatgtgagaaagcaagttagggcgaccttattaaaaagtttatagacagtggcgcaccgccaaagatgtagaaatgtggcttgctgtgttctgtattttggagcaatcactcgggtaccctgtgttgtgagtaggggtgaaagaagagaatcagtggaaccatgggaagcagtttgggagataggttggaaaaatattggaatgttctaagcatgacattgtgaaagaatgctagaatctttttcatatgaggggtgttatggaaaataaagaaagtattggccctgccctcaagaagcttggaacataaaagaagtaaaacatgagagcagggcctaataatgtatctcaaagtgctgaaggaagcatatgcattatagaagttctcatcctggactgtggtttgttgagaatgcagctgggtggagtctgaggaagtaagtgatggccataatcgaagaagagataagaggtaagagcaatggcttaaaagcaaaaaagcctcaaaacattcaaacttcctttgtataatagtggatgttattttgagaatgtcagtttcaggagataccataatcatgtgtttgtctgtatttaaaaagccaccaccataaaagatctagagtcactcatgaagttcaagtaccaatttttacccatgagtgtggaacattctgctcttttacaaacagtaactcgtactgtcacattttgcggcgcatctctcattttgttggttatttagtggccatgtaaacatgtacatgacttgtggtgaatatggtgattctcactttataaccaaagagggtggatgttacagcatatgagcagttatgactgtaaagcctgaagtgtgagtcacagggtctgacccaggtagtaagatgtgttatttgttcatgttggttagctgaatttcctgggctgacctcactgaagtttgctccagtaaagaaccggatctttactgatagatcaaggatctgaattctgcacctagttctttggctaaccagttgtgtcctttgggggaaatttcttaatctttctgctctccatttccctttctgtaagtaagggattagaccaaattccatccaggattgagaaattctatggtgtgacaaagactgctggtgctgactgaatatccttacagatttgttcatttagtaaccaatataataaagatgactgactgaatcttaattatattgggtgacatctgcctagtcaaaagattgcatttctcaggctttctaagagattgatgcagccaactacatgttagcagagggagctcctgcctagaagcactcacttttactcctcctcccgtttgtgtagtagtgatttggtgctggtgctggctggagcatcagtagccatcttgtaacctaaatggcagaattgagaatggaagccatgtgttacggatggtggatcagaaagataataggaacctaggtccctgataaacatggtgtcaccattccaaccttgacctgtttctagattattttctttacttttctttttcctttcctcttttttttttttttttttttgagtctttctctgtcacccaggctggagtgtagtggtgtgatcagggcttactgcagccttagcctcctgcactcaagcaattctcccacttcagcctcacgagtagctggaaccacaggtgcatgccaccatacccagcaatttttttttttttaattttttgtagagatgaggtctcactatgttacccaggctggtctcaaactcatgtactcaagtgatcctcttgccttggcttcccaaagtgctgggattaaaggcatgagccaacatgcccaggctacattttcttaatatgagataaaaataaacctctttcttattgaagccattactagatgcctaattcactttctaactaacatattagcatcagattatctttatgtaatttccattgctaggttttctctttgcagtattggagacaatagcttaccaactagcttgggaacttcttagtgctattagagtttcaacacaatttaccaaatttctaaaattatttagttattggatatatgaaaacataatcaccatatgtgaagaaaaaaccaccaatgtttagtacaaaaattgggagggggaatattatattagagaaagtttattaatccagaaaaccacagaatttaaaaaatattggaagttgggaatttgggagttaaaggtacatttgatctttggttaatggcaagttcacattttataataggatgtaaaaccctatttctcactgcacctgtactttgatcttcttgtctgtcattgcaatgtgattatgaggattactgggtcactctcagcctaagatgtttttgtgacttaattttctaggagaggaaggggatcattaaaggatatcattaaaaggagagacacaaggcttgtaattgaccttccttgaaagtagtcccatctggaagattttatcagtaaacatttatcagtgtatttggcttttaagcagactcttctcctcttgtctttgaaacaaacaggcaaaggctaaaaaggaacacgttagtgctcaaagtttgcttcttgtgcatgctgaatgggaagaaaaataatatttaagaaaaaagctttcttctaagttaattacatgattcttttttcagttttgcttcaatgtttctgtttgccaaattttaattggcaagttatggtgttcttcaatgattatgccttggtgtgatttgcttggatgtgtgtttagagagtggagggtagaagggatgagatttttgtgaaatacagtgagcaggggcttagaaaacctactgcagttctctgtgtgactaagcccagcactagtctgaaacttcgtattgtacttctctggaatgcaataactatcgtcaggaagacaaacgttgctgtggcttaaataaaataaactgacatgatgtattaccagtcaaaataaattacccaaacagtcttgtaaagttgtgttttttggtcatcagaactgcctcattattcatgtgtctgtttgtctctttggttagttttgcttgttgacttgcatgtatcaatgatcacaatccttgtcatttgccaattccatataaactttcagaaagtgaaaattgcttttaagaaatttattttgaagtttctacttatatttacccacataatgcccctcactgatagccagctttgtttcttccattcctttgagaatactccctagtgaatttaaagagtaaaatctgatgttgtggattataatattatacaccaataagtggttgttacacacttgtgtccacacttggtaagatgtccttgtggatgtatctcttctatgtatagtatattaatggctttatccgccatttaatgtggttcccatgaggtttaggtagaccatagatactgtttcaattagaacacttcatgaggatttagtttctctgtctatgggtcctgtatctgaactctccatttttattcttttgtttgttttttgttttgttttctccctgatgcctgatatcagaagaactctccatttttggcttcattctctgctctatccacatgagacagaccaatgtctgcaatctagtgccatacctttccaggttttttatgtccaacaaaaaaagagagcatctctttctagtagctcccacataattaagggtatagcccctctcctgaaccaatcagtcaatcacagtggtcccatctgaccatggggatgttccccaaaggaaatcagggtgttatttttcaaaaggaagaagaaataaatgctggaccttcataacaaccaattgcccactaaaagtgcagtcatatttcttgatgaaatagaacctctccttgtatactgggctccatgacacattgatcatggttagctagaagattctgaagtcttattatccactttgccagttacatttatttgtagctcaaggggactgttaagggaaaggggagcagtgctaaaaacaaatcccattccaatattattaaaaaaaccattgctctgcccttcctttattcacaacttagttcctcatcctcatcttccccagctcctccttttcagctatttcctctgtaggtgcccctaccactaactcccacagattcccccatctcctttgaagaaaaaagctagatgctcccactccctttatttcttccacagtaaccagcttaactagcacacggctttgtacatggtacacagttaagtaatatttgtgaaataaatacggaacacttaagggaaataaaaagcaatctatcctcatcaagaatgagctgagaatccctgagatagcctatttagcagcttagcctgaattctgttttagtttctgtttctggaaactcttcttattttaagaaagaatgattcttataattatttcatatttgttgatattatccagtcttagccagttatcaaaatggtcttgagaattaggaggggaaagcataatgttataaacatttcagcatattgtgcaagtaaagtcctggtagtctgggtaattctagaactcgagtagacttgaagtgatatcagaggaaagctattacccaagtttactgcttgctaatcaggcagccagcaataatgagatggtacaatagaaatgttcaaagtaaggtttcttggcatacatagctatttaattattttatttctgaaagaactatagctccactgttacctaagtttaacctttaggcatttaatataatagtatctctagtgtaacagagggaatcaattactatgataaaccatatcctttgtaaaagaatactataataccaagaaaggcttttgtcttcatctttttagtttttggttattttttgttccattccctttaggtaagaataagcatctagaatgcctcattatgagattgttaatgaatattttccattgtaatttaataagcctaaaaataagaagatactcctctactttgtcatacaagatcgttgaatggtgggtcattagttgatagcaaaaagtcactcattcttagttatgtttctgatgacttgaaaaattgagtggcagtatacaaagtctgagcaaaactgacttcagaatgagtatttggctttgatttctcatggcatcttgcccattgagccatcttttcagaggtctcagctgtatgaaaaaatagtacttttttttttccagaaacatgaagtctggcaatctttataactttgtgcagcttgttgattcccggattcaatggtgttagtgaaaaagaagtctcaggagctccagagtctcagaagaatgacaagaagacccctaattcttgcctgtctctatatttagtatccaagttggggataaaagctagtttttaagattttctgttcagaaatcttttctatatactattcagaggcagccctttgtttaaacctttttttgtctcaggcatggattaactgcaattggattctatgttaaaaatgtatttttttgaacattttgtaggcatcactccagtattttctattggtgaaatcctgatctttttctgtgtagaaatttttgtgaccttcttttctttactgaagttcccacatttcatgatcaattgtcttggtctgcatttttatccattgccctgggcacgcaatagaccttttcactccagagatatgagtccttcagttctgaaatgtttgctcttattcattgataattttatgccctctattttctctgttctttcttccttgaattctcattatcttagttggatctcctagatcatatcctttaatttcttaattgttttcttccttttttgtctttttgttttttggtcttctagaagatttgttcacacacatttttattttccaaccttactattaaaatgtttattttggtcatgatttaaaaataatttagcactctcattctctcctttttttttttttttttttttttttttttgagacggagtcttgctctgtcaccaggctggagtgcagtggcataatcttggctcactgcaacctctgcctcccaggttcaagcaattctcctgcctcagcctcccgagtaactgggactacaggagcatgccaccacacccagctaatttttgtatttttagtagagatggggtttcaccatgttggccagggtgatctcgatctcttgacctcatgatccgcccacctcagcctcccaaagtgctgggattacaggcatgagccaacatgcccagcctcatcctctcctttttaatggtatatgttcttatgtcagaagtgtgttttatctaaggtcacagattattatcctcttgaggttttcctctgtctctctctttcctgtagatttctttcttcagttgatgtttgcttcttctagtttctcttcttcattatggagagtttccttaagaggctgttcattcttagttaaaagcaagacatatacaggtgcatatgcacacacacacaaaacaaagcaacaatgacaatgatggcaagaaacaatgtcagaagttctgtgatcatggatagggctcgtcaactgtagggttgcactgttgcatcataggttgttcaatcaaagccggtgtgttctttgaaatgtttccccaaggtcatgattagggggtaccccactttctgcctgcgagatttgcgcctggggcatataactgactgctaatgtctggggagcatgacaaataaaaaagttgggtttcttattgcaaactctataggctttcaaataagcacctatttcgcaacctgcagcctctcctagtttgctacagtgcctagtatcatcagtttcaaatctctctagccgatttcctccaaaaaagaaagactccgcttccagtaggtaagggaagtagttagtttggatccaaaggctccatataattttaatacactttcagcccctcgctaaactcctgccttccttaattctgctgcctccaagcagtaagtctttctggattcgggagaacacattagtccactttctcttggaatttactctccgtaaccatttcctcgattatgctaaggcacttcagctattttctgatttcaaaaaatcagtagaaatctctcctttgctgatcttgtttcctttattatttgtgcctttgtgggtgggtgtgttgtgtttttattcctttactttcacttcagtgaagtatcagtaaaagagaaagaagataagcaggcatgatttcaccctctcttactggaaatccaggggaacgatagctgaggaggaaagtagcttggaagagcaccttagagtagaaaaagacgggagaaggtgagtttacaaaagtacagcaagatgatgatgatgataaataaaactcaatgcgtgctcactatgtatttgcactgtgcaaagttctttacatggattatttatttgtgtttttgtaagaacacctcaggaagtagctattgagacacagagaagtaatatgacttgtttaggttagtaaatggtagaggtggtattcaaattcagatctgatttcagagaccatcctctcaactgccacactatcttgcctcctacaaattgcttaagcagggatttaaaatgaaaccgtacttttacaaaatcatttttcatgtccattatttaggagtctctctactctatcaaaagtattaattgacctatttattaatatcttagtaatgtaaaatgcttttaggtttgcaaattagtaagagaaacttcttcagattaatagatgctgtctttatgaggactgcatgagacttatgtactcatcattatatacacccacagacgatctatttgaattctgtactcttactcttttgttaaataaatgtactctttctaactatgttttaaatcatctgcaaagagatggaagctgtgtgtatacaacagcaaacatctggaagaaaagaatattcagccaaagcttgttaaagagattcataagcaaagtatgcctttgaattatgaaaatgaattcatgtccaacatcataaagaactctgacatgtctgtttatgtttcaaacatggcttagagatcactgagattaaaattcaattaagtgtgctctgttgtctttgctgtcaatttcagttaaaccagacttgtttggcagttttggggagaaaaatcttcagtgttttaccttgctaacattttaccatttggactttgtgttttttcccaataaatgcatgtcatttaaggagatgcttcatgttatacacacctggtgattttcatcagcagttgtacagatgaaagagaagtaaaagcccccaaataattcatcttttaggctttgtaaaattatcattttataaatttttaaattgtgaaatataacaaaatttaagaaagtatgtaaaatttaaattttaagtttaacaaattgttctaaagtaaatacctactatgatcacccctcagaaagaccctataatttcctgtttcatcctctccagataggtcaccactatcttgactttacttttacttttcctacttttctttatgatttaccacgtatgtatgcatgccaaaacaacagttcaatttagtttgttttgcattttatgtaaatggactcatcttgtagatactcctgtgttttgctccttttgtgcaatattatagttgtaaaattcatcaatgttgtatgtagctgaggattgcacatcataatatatatcatgatatatagcattctgttgtataaaggaaccacaatttactgtccaatcttctttctttatgcagttgaacatatccagtttggaaatattatgaataaagatatttcgaacacttatgtgcgtgtatcttgatgcacataagcgtacatttttgtgggggaatatacctaggagtggattcatgggtcatgcatatctttaacttcagcagataagcagaaagcatttgacaaagtggttgagaaggtaatgagaattcctgttgctccacgttctaataaaaaacacttggattttctttcttttttttcaaatgacagggctctataatgggatcattgcatttctctgattactaatgagagtgagtactccttcatatgtttagtagatatttgaattgtatttgtttttgttgttgttgtagctcttcatgaaaagtactttctaaacagcatttctgagcaccctttagggagccaaaggccaaataagttagagtatttgtcacaacatggcaataagagaggcgaattcatccattaattgcttgccatatgcttatcactggaatatattttgcagcatctcctgacatcactatttatcccttttaccaaaaaaaaaaaaaaaaaaaagaaaaagaaaaaaaaaacatggctactgataatacttgggagcactcaacgaaggtcccgtctgagactctgtagaatatattatagaatgcaaatattctttggattccgtcttgttgttgttgttgctgtttcctaccctacaacttttggcatctctacccaacatttttataatacaggactgtctctgaggtttgttttccttatggttgttctcatgtataaaagagatgatgatagcgtttctcatgccagtatgtctgtgtatgatttatgttgtaaacagtgcaaagagctttacagccattgtctcactaatcttcagagcatcttttcgaaatagagaggagacaagtgaatcaacatcctctatatcacgggaggaaacatatctccctgtggagagatgtccactgctttatcgacaaggcacaaagctgcgaacagaattcaggttgtattctgactcctacactaatgcctatggactagacatggtgtaaaattttatatgcgtgaaacatgaggtgtattcatcaactgatcactattagcaactggctagaacatgaagtgtttgtttgtttttcaaaagaaagatatgatgaaactttatatgcttttacacagttctgatattttaacaatttgactaatttttatagttttattccttccagaaattcctttaactgtgcttatcccgtaagtaattgctaatgttcttaaactaatcgagaaaatcatttctattagtccctaaatacccagacttcataccttcttgcttcccactctcctcatatctaatctctcccttaggtttagcaacaaaatgtgcagcttgacgtggtcagtgggtgtctgaacatttagtgctagtgtttcctctcatctctctgcttttatttggacttctcaactcttaaaagtaattttaacatattataagaaatctttgaatttataacactttacagtttatgaaagactatataaaggttccttctcacaggctgtaaggggtacaaggacaatgaaactcagatgacatccttaaatgcactctactattatatggctaatttaagattaaaaatctggtttcataattattagtctagtggtccttttataggcagcataatacagttgtaaggagtacagactgcctgtttttgaatcactggtccatgctaactagctggcttaccttgggcaagttacttgaggttctctgtgcctcagtttccccagctatcaaatagatctaagagttgtgaaaattcaatgagttgatacatataaaaatacttaaagcagtgcctgtccaacataaatgcttaataaatgttagccctattatctttcctcattatttagtgttaaagagcaagaacatctataaaaataaaaatcaaataatccttcaaaaattcctgaatattataaaactaacatataatgtcaactaaaattgataccaattagtttccttatcttgaatgaaatcagtattgtagtcagagccaagctactgacctggattcacatataacattcagtttctcttctgaaactccagctcacttagcacatttatgccaaaaacaacaacaacaacaacaacaaaaatgtataaattgcctcatttgtttgaagtgtaacactcaggttttccatacagcaggaaactctgatagaagtatagattaataggcaaggcattgctccattccctaaaggcgtaataaggctattccacaaatatgtattgaacttctacacaggtttaagaattatgaggaggagagaagatattgtaatgaatccctactattctgtttattttttatttctttttaacttttaagttcaggggtacatgtacagatttgttacataggtaaacttgtgtcatggggtttgtagtacagattatttcatcacccacatattacacctaatacccattagttgattttcctgatcctctcactcctcccaccctccaccctctgataggtcacagtgtctgttgtttccctctatgtgtccatgagttgtcatcatttagctcccacttacaagtgagaacatgcagttcctgtgttagtttgctaaggatattggcctccagctccatcagtgttcctggaaaggacactatctcattcttttttatggcttcatagtattccatggtgtttatgtaccacatttgctttatcctgtctactactgttgggcatttaggttgattctatgtctttgctattgttaatgctgctgtaatgaacatacacatgcatgtgtctttataatagaatgatttatattcctttgggcatatacccagaaatgagattgctgggttgaatgctagttctgtttttaggtctttgaggaattgccacactgtcttccacaatggttgaactaatttacactcccatcaacagtgtataagtgttcctctgagtacctgttattcctttgaagaaaatacctacacaactagataattagagaaggagagaaagagaaagagagagaaggatggcacaataataaagtgttttttggaggcaaggatgatgttttatgaatttttgtattcccagaaaataacagataagtggttattagtgaatgaagaaatgaatgagttaactaattgtagcagaaaagggaaagataaatataaataaaggtcatccatctatttaacaaacatgtattgcatgcctaggaattgtacttggcttgaagactttaaagtagattaagacagtcccagacttcaaggaccagcaactgagggtgttaaacagaaaggacaatgacattacaacaagctgtgggttcacacataccatttcaagactagagaagagaagaaaatcagagattcttccagaaatgaaaattcttgagctggggctttgaggatgaggagaagttagttagttagaaaggaaagatgagtaaggttgggggtcaatagttcgagcaaatattgcagtatgaaaggtgtgagagagcctcaaacaggttacagattgtggcactataggtgatggggaaggagtgagagaggtaactacagagaagtaacctattaggaactgctaagaaatgttagatattatgctaaaaagcttggaatattttttaaagcatgggggcatcacttgatgatctttctcaaggacaggactattaatcttagggtttattatattcttcaattttgacacaatttatacttcaataattctctgtaagaatttttttcctttgtggtcttatttatttattgagatagggtcttgctctgtcacccaggctggagagcagtggcaatcatggctcattgcagccttgacctcccaggctcaaacgatcctcctgcctcagcctcccaagtagctgggactataagcacgcaccactgtgcctggctaatttttaaaaatttttgtagagacaaggtctccctatgttttcttggctggtctcgaactcctggtctcaagcaatcatcccacctcagcctcccaaagtgctgggatgacaggtgggagtcaccacatctggccttatttttttaacgtattttttaaaaacccaagaacaggcattttctgcgtaatgtgcctgcattttggctttgtatttactaatgcttgaattattgccttagctatacataatcaactgaagaaaagtatttaacttttagctacagtgatttctcatatggaaactgtatacttctcagggattgtggaaatgtccttggaagtctatgacccctcaaatttgagaaatgttgatgtggaggtagaattggagtaggcaggggaaagacaggtaccaggaaaaccagttcagagcctactacaataatcatatgagaaacaaagagggcttgaactaagggagttcagatgaaagaagaatctaatagttatttatagagtaaaatagacagaacttggtgacttccaggattttaggcttgagagagggaggactcaagaattgtacatgggtttctggtttcagtgattagatttctggcatctgctgtccataagatagtaaaaactgcagatagggtaaatgccagtattggaaatatgaagtttgaggtgtctgtgcacatccagatagaaatttatggaatgtggaagagcaatgtaagctggggttttcagcacaatggtaggtaggtattgtagttttgggggtgaaggtactcacacaggcaatgagtagactaaaaaaacaaaaatatagagaaagaagaatccaacaaagagattgagaagtagtggctgagaagtaggcagaaatttaggagagtggtgttctcaactccaaggtaggagagaattccaagattggaattgttagaaaaatttgatggagaaggtattctttgaactgtgtgtgaatagacaaagagctctgacagagcagaaaggaggaggtatggattctgggtgaggaaatgttataagcagtcccacaaagagtgacatcagatttatacaagaagccagagcttgactgtagtgggcagtacagcatagggtggaaagcatagactctgaaaccaactccttaggttcaaatctcagctctccacttttagctatgtgacccttggcaggttatgtaaccttctaaagcctcgattttctcctgtgtaaagtggaggcagtgatagtacattgttaatagattgtttactttttactcttctgtatagacggaccccttgcaaaagtcagggtgattttatatatacaacatcgttatcagctacctctgaatacttgattcttttccttctacaaccccaacctccatttgaaaagttctcattattctttttcttacctattctaaaagtatcactcagtccccacttcctccagggagcttttctgacgagtattcagctcttacttcttagacctccagtaacatctaatgtttgtcaagtacaattaagcacttgcttttacaaaactaattgtgggagattatttctaatggtttcatgttttttaatcttctatccccaagaaagattgtaaacttcttaaagtcaagatacatctccagggtatccgcacattttgccgtgcctgggacactcagtttatgcccattgtcctgatatagtttatatgaattcataatttatagtgtccacttttgactctctcaagagggtagttgtttgcatgataaattccatgaacaacctggatataataatacatactttttgaaattagtaacaaatatttattgagtggctatagcatatctattacaaaataataataagcaagggggagaaaacgaactgtcaataattatgccattgagagataatttttctgtctctgtgtgtgagagtgtgtatgtagagagagaaggagttttactaacaacaatgagattatactgaaggtaatattttataatctgcttttaaaatttcacagtatattgcatcatgaacacttttcttaccattaaatacaattctctatataacattttaatggcatttccttacatgaatatactacacttaagcaattttctattattaaatatttgaagctctccccagatttcacattataagcactattgtgatgaatatctttgtgtagagtctttatagcaaggctgggttgttttcttactatatatttctagaattagaattgtcaaactaaagaattgcccaatattttaaagatttatttttgctattattgtcatattgccctgcagaaagtttatatatacttcatcagcagtctctatttctacattatttccgttgctatattttatcattttaattgttctctttatttgatgaatcacatagtattttgttttaataagaattaatttagcttcaagaatattaaaatctgttttgtgtgtctaatggcaattatacatatttgctttttattattttattatttattcgtgggctgatttgttttttcttgttgattttatttttatttattttttaggagacaggtgtctcactttgttgcccaggctggtctcaaactcctggactcaagtgatctgactgcctctgcctctcgaagtgctgggattacaggtgtgagccaccacccctggcctcttattgattttagagtgttctttagagattaagaatattaacttttcatttatgtttgttttttacacttttttgccatttattcatttctatttttacttttacagatactctattttaataaatagaagtttaaatagtccctatgtagcctgtatgtttatattgtttatatagtctctatataaatatattttataaatccttagcaattcttttccaacaccaatattttcttctagtatttaatcattttacatcatatatttatatctctaataattatggaatttattttactttatttcagggctctgatgttcttttcctagattttctaaattgtcagaatcctaggtattacataatctattatttccttattggcttgaaatgccacttctactgtttatggttagttccttttttaatctttacatcctatttctagacaaaaagccccatgttataattattatggattttaagaaatacattttaatatctgggagaacatattccctcttaatcttattttttagaatttcctgggttattctcacatcgttgtgctaaattatacaaacaatctacttgtcaagtcccccccaaaaaaacccattaagattttgattgaaattgcattaagttgcttataagcagtttataagtactacagagctccttatgatatccctgccaactacttaagaaactcctagttcttaaattacaaatattcccagtcaagaaaggatcaccagacatttgaaaaaagacaaaaaaccaaaccaaacaaaaaaaccagtagcctaaacaaaaaggaactaataaataaacaggacaaatttattttcctgagacaatttatcttctgctttccagaagaaacagagacaatgaaaagtgtgggaaaaatttgtcaatattaaattttcagagatattcagggggagaatataaccattaagtatgatctgatttccataaatagcagaatactgaatatatatgtatatataaagattggataaaatgcaattcaagtaatattcattcttgaatattgaattaagcaaatatcttagaatatagagcaaaaagccaaggatataaaatatgatggaaaagtaaaaaagatatgaagaatgtggtagaagtggaggaatgggaaaggatgtgggaaaataacagaaaaaaaatccttgacctgaagagtaattcaagtcctcagattgaaaagtttcatccaacaccgaacaaggaaaaaaggatacatatctagatgtgtatacacatgctgatgaaaattttggaattctaagtataagaaattaatccttccagagaacaaaaaaaaaggatctttcaaaggtatcaaacttctcatcagcaagattagaagtgaatgcagactaggcaaggtttcaaagttctcaggaagaagaactagaacccaaaattgatagtcaaactatcaagtgttaagacaaactaaagatgtatttaaacatggaaggactcaagtttacaactttacctcctacagattcttcctaattaaaaggaagtattactcgaagatatattcaagcaaaacaaagcaacgggaatcctatacagaaaacctaggatacaaagagcattggaaccaacccagatgtttatgaaaataaatcccagtatgacaactgtgtagtagtaggcctagaaagcaggcagcctaagttagagtcatcagaaggttccaggaaaaatgctttcaagaagaaagtagacatcacatttcgaattgcataattaagagccttttaacattttagggcaaaagtaactgcatttaactcatagattaatctaagacttgatatctttataatattgactcttcccatgtaggaaactagatatattcttcaagtttttaaaaatgtccttcagtgatgttttgcaataatatttatacaagagttttacatttttcgttgtttatttatacatatttgatatgttttattactattatgaataggatcatttatctattttctaactggtatatagaaaaaaacctgttgtggatacatgctttataatgtttgacctttcttataaatcataatggtctaccttttttatacctttcagttgattctcctgaattttgagttacagaatttttatcttaaaatagaatgatttccttctctcttaaaaatatttgtacagcatatttggttttcttgtttggttgcttacgttagaattttctgagcaacattcagtaatagtggagacagcttctttttgtttctgatttcattgttaattatagatgtcgaagaaaagctattcattaccatgaaaaggaactattctattcttattgtactgagagtgctattttactatcaactctttaataagtgtgatatactactgtattaggccattctcatgctgctgtgaagaaataccctagactgggtaatttataaagaaaagaggtttaattgactcacagttctgcatggctggggagacctcaggaaacttataatcatggcagaatgcacctctttacagggcagcaggagagagtaagcaccagcagggaaaattccagaagcttatataaccatcagatcttgtgaaactcattcattatcatgagaacagcatgggggaaactgccctatgattcaattatcttcacccagtccctcccgcaacacatggggattatggggattacaattcaagatgagattttggttagggcatggccaaaccatataatctacattaaggacattgttaagtggcaggataaatggtgtgggctcaactttatactatagaggaccattatagcaatatcataaaagtaatactttgagagactaagccaataataggacaaatataaatttgaggaaaagatatacaaaaccatttagtaattcaagcatctagtgataattgtataaccatatggacaaaggtagagaaaaatacctatagaaagtttgaacttaagagataggtcaggtaacaaacccactttttttcttttttttttttacctgattacttcctggtcatgaggttcaaaatatttgatagcaaaatgatttaaagtccaaattaatattgaattgaatatacacattacagccaaaaccagacctatttttctgttgcttatcatatataattatagaaagcataactgaacaacaggaagttattacttcttaaatatcagaaaacatttgactttctcttctgaaataaggaacggcagtaaccgaattctagttactgctcttaatagttttgtagttctcataaaatattgcttatatattatttggctcccacactatccattttgatggttttaaatttttcaaataaaaataaatgagttttcatactatggatgacttgacatcagttaaaagtgtaaattcatacttgaagatagcaggactctatgctctttcctcattgttctggtcaaatacatttccaatcatgataatcaataatgtgactattaatttttacttgaagttaatctattcatgtttgattagaagtgtctaaaacataaacttgggatgtcaatgaagaactttttaaaattctcctccacaatggctgataatcaggccatgattatattttgaagattttacctagttagtcatatttggggtaagaatatatgctatctccttcatattaatagttcagatctttaattataacatgtttcatggtctataagattaaattgaacattaggaaagcttagcatttctcatttgtgagtcttacattcacacctgtcaggattggtacagattcaagcttgtttttaataaacttcaaagaagatcaaaactagggatcatctgtttcatgtctttgacgtgatagaagtttggggcccccgttttgccctgtagcttttgcctaaggagaaagccacccttttcagctgatacttgctcccacaggtttttcacagtttttgagtagcgagtggcaagaagcaatatgacgatgttggtaggtagagagatacttcttcaccatctggtgagcattctggagaacagagacaagtcccacactgttaaaggagtgaagtcattttgcagccagttttaaggattgatttaagaactctaggagcaggccattatgtagtcatccattcagcacgattcttcgtgggactgtttacactagaaggaactgtagtgatcaatttagcgttgaggaaactgagggctacagagtgccagggtcacgttcatcacacttatttgtgtttcaaagcagaatccacactccaaaatgtgcaactactgtcttactatggaatttacactgacacattctgaggtcatgcaggaaatagaccagagtaaagcattagcaattaggtcagtagcttgagataatgcaggctctgaggcaatcttcactttcactgaccacagactgggattgggaacatgggaaacgtgtgtgtgtacagacacagcaacccttttctatgtgtcatgtcttcagctgagttttaagttgtactagtggaagccatagcctatgttggctcataggtcctagtgccctttccccttcccttgcctctgcccctgcccctttccttgccttgcccctgcccctgcccattccccttctcctctcctctcctctcctctcctctcctctcccctcctctcccctcctttcctttcctttccttgacactgggtagagtgtaatgcaatcatagcttactgcagccttgaacttccagggctcaaccagtcctcctgcctcagcctctgggtagcaaggacaataggcacacaccattatgcccagcttattattattattattattattattaattttgtagagatgggtcctgctatgttgcccaggctggtctcaaactcctggcctcaagcaattctctggcctcagtcatgcaaagtgtagggattacaggcatgagccatctcttccagctctagtgctatctctttataggaatcaaaaatttgttttggctatttcaaattttgtagagtaagaggtcaattagaaaagactcagttatgttttcaaaaatgcactgtgtgcatatgtgtgtagaaatgtattagaatgaaataacatttttttacagtggctaccattggtttgtgaaattatgcatgctttttcttaattttctctaatttttctctatttcctaagatttctaccatgagatttttctcttaatgtctagttttattacataggtaatagataaatatattcatgtcataaaatatttttaaaattcagaatatgagaaagtcctttttcatgctccttagtcttgctgtctttcttgaaagtatccacttagtgatggatacaatatggtgtatatctgccttaatccattttgtgctgctctaacagaatacttgagactaggtaatttatcatgagctgaaatttattggctcacagttctggaggctgggaaatctaaaatcaaggtgctggcatctgttaagggtccttttgttgcatcaccacatggcagaaagcaaaagggagagagatagacagattgggagagagagaggaaaggggaccaaacgtctcactcttttataacaaacctgctccagtgataacaggattaacccttacatcagggcaaagctcacatgacctaacacctcttagaagtcccaactcttgctggatgtggtggctcacacctgtaatctcagcactttgggaggctgaggtgggtggatcacttgaggtaaggagttcgagaccaacctgcctgagcaacatgaagaaaccctatcaatacaaaaaaatacaacaaaatagctgggcatggtggcatgtgcctgtagttccagctactctggaagctgaggtgggagaatcacctgagcttgggaagctgaggccacagtgagctatgatcatgccactgcactctaacctgggtgttgaagtgagaccctgtcaccaaaaaaaaaaaaaaaagagtcctacctcttaatactgttacaatggcaattaaacttcagcctgagttttggatggaacaaacattcaaaccatagcagtatcttttcagaatttttaactgaatatttatatatatgaacatttagaattaggggtaatttttaaaaatcaaaagtgatatactacagatgttattctgtgattgatctttgcacttactatgttttggagattattttattttagtacgtataaatctataccagttttcttaaattgcagcatagtatgtatatcaagtttatcctttaactattttcttactgatggccttttttaatattgcaaaccatactacactaaacattgtcgtgcatacttccttgtgtattacattggtttttaaatcaatgaactagttgtaaacatggagagaaacaacaaggagggagatggatataagagaagaagagattaaaggggatggaatcagttgtttctggagcacagaatattcaccaaatttgaccagatgcgcggttgctcatttaggaaagagcaactgcactgggatgaagaggttttttaggaaatcagaggtcttcagagaagttttggttaaaatctgcagtatacactaccaaaatggtttttgtctttgttgttcttatgcaagaaagactagctctttttatctagagctggaaggttgctgtcttggagtgggggagaaaggagacaagtatctgatgggtgggaatggaaggtgtgtatccttgcagcagacctccagagtagctgactgactgatatgcatggtagtcctaagatgtgtttgagaaaagaaaatattaggagctcttgacaaatcttgaaaatcaatacaaaaattagccaggcgtggtggcgtgtgcctgcagtcccagctactcagggggctgatgcagagaatccctagaacctgagaggcagaggttgcagcgagatcgcaccactgcactccagtctgggcaacagagtgagactctgtctcaaaaaaaaaaaaaaaagaagaaaaaaaaaatcagttgcccatcctgcagatatacagtatagtgtaactgcttcagccgcttgcaaatctcttttacaattcaaaacaaattatggagaaataagagtgaaatattttcctggaaaaataatgtgaaaaattgaagttttaaatatcatagttaaattgaatgtaccttagggacaactcctttatttaaaactccaattctccaataacacacctaatatttgttattttgttgttaaatatttactctatgtagacattatgctaagagtataatgcctttttaatattcagaagagcactctaaaagctattacagctttacagacaagaaacttgagaccagagagaggttaagtaacttgaccaattgtcatatagcatttaagtggcagagttaggatttgaacccaagtttttatgtatttaaaattctggctattaacaccacactgcaaagaaacttatttagtagataacaagttatatccatatatttttagatatcaatatatatgttgtggatcggtagcttggggcacattactgctttgaattgtggtatcttttattagatattgaaatactggattattgataagaccatgtagcagtgagaaaaatagtttttgctttgatttgtgtcagttatactatgttgttggagcttttgaagtagggagtgatcaggtagagacaggcagaagagattagtttgtatgtgttatcctgaaatctgagttatttgacatttttaaggcaaggcattgattgagttttatgaagataaattggcaaagaaaagtaatcccatctgctcaataacaattctttgcttttagccaagaaaattgatttcaacttgagagtaataatcatatttatcacacttgttaattgcatgaactgtatacaaattgtcaggcttattaaggtagatatttacggtcactgggcgttcctcacattccacattttcattgttatggcattaactattttttctgtttctctctttgtcactgaagacttcacgtagtataatagccagtattttctgtgattatatagcaatattctcaaacctaattgttcatacaaagtacaaatcagggactttttctactaggttctgaagtacttgttctctagatttaaactccagtgttgtactaatgggagtaagtttttcttttatctgccaaggagctcctcttacatgtaaaaaactgttgtttttcctctttgtaaatatcagtgtaaagtacacactgtataaaatgtaaattactgatgtgagagtggccattttattcacattgttcaatgccaaagtgggccaaaggattctggctcattaactttaaggaaactatagtattcttttgtctctttagccttccttctggtttattcaaagaattctcatcaggttgatcaagagttgaaaagtaaagcactgttcttaaaaactgctctctagaaagatctgcaatggttttgaggactgccaagcaacaggaggtagaaaaatggataactaaataacctcatttacagaaaatatgttaggttaaattgcataggaaaagatagtatgggtctttaaaaaaaatggatatttataacaaagaaaggataaaattaataagtaagttataaggaatatttagaaaaataaaaacagtattctaaaagacaatacttatatctttctaatgtaaatcttagaaaatggtgagaatttcttgtatgctttatatttataagaagtaataatagcttttgaaataattccatattataagaagtcttttcttcatatgtacccaattccaaataagtggatgctggaagaaaatctgtaatttattttatttaaaagaaatgcagtatattaataaatacctattttttggataataaaataagcaacattttccagaatgaggtttttttttgcaacaaatgtgcataccaatgatttgaagtatttaaaagaaacttttctacttgaaaggaaccaagatgactaagtactaattttgcggaatctccaattgggaggatatctactgctcagaaaagcaaactaaaacaagacaagaaattaaaattgacaaaggagaagttccatataatctaattcaaaatcaaatgagtttttcaaagaaataagtttcatcatgtaatctaagccaaaatgagctgaaaatttacacacaatttcttttctttttctttttctctatttcccattaggtggtttccatccatggaaactagttacatggcattcctaccatcccatgcccatggtagacataattaagaaattgtgtgtgtgtgtgtgtgtgtgtgtgtgtgtgtgtgtgtgtgtgtgtgttttgtaagctttttactccttctcaacaaagcatttcaaggagccaacagcaaattagaattgaaactccattatgtctctcaggtcttctgatcagctcttattatacttactcttagtaaaataatctctattaatagtgagaagtaaggaactatatgatataataaaaagtgctctaaaggaagtcagaacattgtgtggaagtcctggttccaccattaatggtaaactctttgaggacttccaatttctccaggactggttttcaatctgtataattaaggggtttaggctagactctctttttattttttgaaacagtgtctcactctgtcacccaggctggaatgaagtggtacgatcttggctcactacaacctctgcctccctaggttgaagcaatccttccacctcagccacctaagtagctgggattacaggcatgcaccaccacgcctagttatgttttcgtattttagtagagatgaggtttcaccatgttggccaggctggtctggaactcctggcctcaagcaatctgcctgcctcggcctcccaaagtgctaggattacaggtgtgagccaccacacctggcctagacgctttctaaaattcttttcagtttcaaccttctatggcttttggattcttttatttcttatactttcatattactgaatctcataactcactttttcctccattttatattttcaacttttctagtctagggctctgcacaagttattactctgcccttttattactactccaaggtaattcatgttatatgtagatgtatattagccatgacaataaatctacatactgtattatcatctttccagaatttttcaaaacagaaagtctttcttgactaatcatttattccccatataatagtatgaagttattaacaaacgttccttgaattatgtgtgacagaatttgctgggagcttgaatcagtatatttgtttaggctgcatataacagaaggcttcatttaaaatagcttaaataataagagatttattgaattatataataagaaggtagtgatagaatgattctagtagtacaaacatgcatcaagaatccagattctttccttctttctagtcacccatcctcagcacagtagtttttgatctcagttttatcctcttatggtctcaagatgactacagcagctctaagtatatttatacaacttccttttcttctgtcactttttaagaaagataaaaactttaccagaagttccttaacagatttctttctcagatctgtattagaaacaaattcatcatatgcttatatctaagccattcattggcaagagaaatgctatgaaattggctgggaagtaatcatggttcatcctggtcctgggaggggcctgatctcccttgaagcaccaaccgcctgacacctgaacaaattctagtggctgctgggtagggaacaacagtgtctttacaagttggtgcattataaatacatttccataatttgaatcaagcctaccatctcctcctcatctccaaccacccgccccccccgccccccactttattttctgtatcttcagcaacttccagaaacttctcattcttccttaaatacacatttttgtacctgccatattttgcatgccctcttttatcagcctggaatgcactttgtcacctttgcagcctggtaaaaccatcattgtgctcatatttcaagaaccacctcaaatgtctgctctttagatctgaacccttcctgaattccccagcttagcaggtcaagtgagttgttctcagctttgtacttctgctatagatcagccctcatcattttataactatgtattgacccatttactcctgagaatcctgtaaggatgggactcagttccttggtattttgttctcagagagatgatgcttcatacttaccaactgttcaataaagtttgttgaattaatatagttaaaagcagatacctttctgttataagttcaaagcctagtgattgaagatttttctttacattatttaaatgtatttattttggtaaaatatttagagcaagtttcattccatctgttccatctaagcgattcatgacctgcatacattctaaatgacaggaaccacaagcaactcagtcagcaggcttcagaatcggtcatcctaaaagatattgcaggtcaatggctaatacactaacaaagaaagagcttatgcaaataagtaaggaaaatactgtttcaatgttaaatcattaaagacaaattcagactactcacaaagaagatctataaatgccaagttagaatagtaaaacagaaaacaaaaaaacaacatgaagacctctgattacatctatagtaattaacatatccatttaactcctctgccttcagaaaaccatcaatggatgtttataggcataaatgacaaggacaaagaaagtgggaagggagataacagcaacaaaattttggaagctgaaaaacaagtatacaaggggtatacttcctgatgaatgtaaaaccgtccctagacaaggggggcctaggcaggttgaagactgagtgccattctgaaaacagagggattaaataaacacttatatatttgtgttcatgataacacaaggctttttaaattctgtttaccactgtgtctccggtggctagaatagaggctgccaaatatagatgctcaaatatttgttgaatgaattccgaaggttgaaagtcccaaccttcttcccctagtcagcttccaactatgcttaagccttctggacaggagattgatataacctttggagaattcaccaacccaagagaaaaaacccaaagataatggtgcaaggtatttctgaatgaaactgttcagttggatcatcaaaaagtggatgtagttgacaaatcttacctatgcaaacagagcttccaatctgatttttagtactctagccttaaatatgagtagacagataagatttatcaaatacttagaaaaagtaagtgaaagaaaccaaaacaaatggaaaaagaccaacttcaaagtacagatgttggccgggcgcggtggctcacgcctgtaatcccaacacttcgggaggccaaggcggggggattaccttaggtcaggagttcgagaccagcctggccaatatggtgaaaccccgtctctactaaaaatataaaaaaattagctgggcgtggtagtaggcaactgtaatcccagctactcaggaggctgaggcaggagaattgcttgaacccaggagatggaggttgcagtgagccaacatggtcccactgcactccagcctgggtgacagagtgagactccatctcaaaaaaaaaaaaaaaaaaaaagaagagaaataaaaaagtacagatgttgcaggaagaaggtatcatcagagagaggagaagaaatacacttgatattgtattcataaatattaacattgcttccacgaaacaaaagcagatgctatggaaaaaaaaaaaacaactcagagaataggaaaagagctcttggaaagtaaaaacatgatagaataagttaaaaactcaatagaagggttgaaaggtaaattgaggacatctctatggaaatggagcaaaaatacaaaaaggtagaaaatacagaagaaaaagtgggaaatcagaggaccagttcaggaaatctaacatctaaaatcagaaattctagaaaaaagagaaaactgcaggaggacaaaattgaagaaaaatttccagaactcattaattggagcatttagcacaatataaagtattaaaaaagagacttgtgacttgttctaaggatcattatcgtatcgtatagaaggatcaaaaatcaaaagggcatcagacttctgaagattcgttttgaaacctagaaaagaatgaagtgatgccttttaaattccgaaggaaagtgattctcaaccaagaattctatactcaaccaaactattgatcaagagtgagcatggaataaagattatttctgaggtgcgagcctttaaaaaatgtatctctgatgcatactgactcaggaagctactggaaaacgtgctcaccaaaacaagggaataaactctaaaaacattacccttgggataataaggaaagaacatcccaaagtgacagctgagcaagagacatggagaataaccaatccaggtcaaagaggcctctggatgagatttcttcaagaagatgaatttaataaaattcttgatgtgtttgagccatacttagatttttgtaatatgggaaaagtttgggattgaattagtgataagtatatatggacatctaagggaacaaagaaactaacaaaagacaagaattttcaagaaggaaaacaaagaaaaaaaggtaatcagggtatgttacatagtttagctgcttatagtttttctttggttctgctcatggaaacacaatgactatcaatctaagtaagactataatatattagaaggatgggtgatgagaagtgtgaagtgttgcaaaggtaaatccttatcttccgctatgaagtatcaataagcaatgcccaaaaaaatgaactattaagaagtaactgtaaagttatatcatttagagatagagtggagtatagcaaatgaatcagctaaaatatttgaaaatgggtaccctctggggagtggaagatacatgtatgtattgtgggtgggggatgcactgcaggagatctctttttttaatccttgtggtactacttagttctctaaactatttgcatctataactttgctaaaaataacatttaaatttaaaaattgatcactcttgtaataagttcaaattgaaacaaggagataacatagttgctaagttttatttttggacatatttataacattgtatatgtgttagtgagaataccatgtaacatcactctcaagcagtacttctaaaagtagaaattgctgtaatatttctcaaaaactatctggcaatacacattaagaggtataaaaatgtttattccttctgacttagtacttctgcttcagaaatctcttacagtgatctaccttctagaaagactggagataaatacatcaaaatgttcacagtagttgtctctgagtggtagaattatgggtaaaaaaaagatggcttgtttccatttttcttttgcacccctctgcattttttccaaataatctataatgaagacaggctccttttatatttggaaataatttccaaatataaacattttaattttataacattttaaatttttcaaaacactggtcctcataacaagaaaagttatttgttgcaaccacagtagaccaggttaatggtgccaagagtggaatgcggataaaggctgacaaggccatctggaactgtgagtcattcagagcatcacagaagagagattttctgcaagtactagctgtgttgactgtgactgctgttttcctggttgctcaggaatcacccagggaaggagagggcttccccacgggattagggaaaaaaaaaaaaaagcttcttgttccataagagagtctacagataggatgagtaataagggatagattttactaaggtagaacaaaatgttaggacgctggtacgagcaccactgaaatatccctatatcaagttttagtcttttcattgcatcttctgaacctgctggagatgctttcacatggaacgtatttgctataaacttttctttatcttttgttcaatgctgtgaagtttgctaatcttaatgaaccaagtctcttcatgctgacaactcattgtaaaagaggtaaaactgtgtttccatggtatggggaatggagaggtataaggaggaagatggatttaaattgatttttggaatgcttgctttattttatcagttaaagaaaaggtctaacggattatttagataactttaggctccaactgcactgatctgtttgtcattcctttaagaaaccattttgattctgactacttgaatttgcacattttgttccttctctctggaataccctaacaaattctttctgcctgataaactacttactcttccaggtcaagttgaaatgttcccttcagtgtgaaaactttcatgactcaaaaaataacaattataataattacaatttgatgagctacctggctgtttacctaattctcacaccattagatgagcgaggtagttttaggctaactttaaaaaggaggaaactgagacttacaagacttgggtatgtggcccaagagtacatagctagatttgaaacccaagtccaaacccaggacttcctgcttaaagccccttctttttcaaaaactacattacctattgattattttgctttacatgtgcttacatgttgatcttcctcagtggactgccttcattccttaataggaaataaattgtcttttttggaggtgttacatttttgcatataacattaataagattaaaattttcatttgttgttgacattctttgcttgactctacactccacgggataggatccttgggcatagaaaccacgaatgctttgctcatcactgaatccagcatctgtcagtgtctgccatataggaattgctcaatatacatttttgagtaaataactgaactaacaaatgagtgaacaaaagaacaaatgaataaaaaacctcagatctagcccctaacaaaaaatacttaaaaaaaagttttagtgtctcaattgtctgtatagacaatgatttcacaagttcacgtgaaatacactaccaatatcaacaatcatgttaaatcaaatgaaatctatatcctctgggaatgcttgtggtatggcttagggacaagctttacttatgaacaatgatactgagacttcacaatagtcagctgtgcagatgtcagactttgcatttcacacatgcttttaacctagagctcaaataggcagttttaagccctggacctcaagtcaatgtggttcatgttttgtcacttcaagatctacaattgaacttcattacgatagtcttagatggtttttcataaattttgagtcatgaaaaactgacaacatatgagtctccaagtaccttttaatatatgcaatattttacctacttaattaatacatgtgtttatttgataactaaaaagtttataaagtctagaaataaagaaaagtccatgtcctttttcttttttgttttcttttaaatgaaaactcatgagaaataagagggcagaatgcattaaattatttcttctgtaacagcacaattctatatcagattttaaatacaaaagaacatgcaaagggataacagcattgacttcagttctaatataaataaggcaggaaattgggtgaaatcagtttttcctctaatcttacatggaaaaaaatttgtcatttggcaaacccatatgaatccgatctgtttggtttattcatccatgcagtgacattcagactccaaaaactgtatcagaaacctagtcaatatttaaatgccatcatatagattagaaatggaataaggtataggtaacttactgcatttcaaaaaaagtactaattgaaacatattgtcaaacatatatctttttctctctttagaaacctatggctattttctgtctttcagctcacgctacagaaaggcctatttttccttctgtcttagtccattcaagctgctgtaacaaaatatcatagccaggcacagtggctcatgcctgtaatcccagcactttgggaggccgaggtgggcagatcacttgaagtcaggagtttcagaccagcctgggcaacatgatgaaacctaatctctactaaaaatacaaaaaaatcagccaaatgtggtcacaagcacctgtaatcccagcaactcaggaggctaaggcactagaatcacttgcacctgggaaggagagggtgcagtgatctgagatcatggcactgaaatccagcccgagtgacagagcaaaactctctctctaaataaataaataaataaataaataaataaataaataaataaatcacgagctgggtggcttataaacaacataaatttatttctcacagttctggagactagaatgtccaaggtcaaggcacggtagacttggtattttgtgagggctcatttcctgggtcatagatagtgcctctggctttgtcctcacatggtggaaggggcaaggcagctctcttgggcctcctttataagccactaatccccttataagggctgtgctctcatgacctaattatctcccaaaggccccacctcctaataccatcacattggtgatgaggtttcatcgcatatgaatgtggggagggacacaaacattcagactatagtatctgctttttgccacagaatgaagaataaaccacgtcttataaataaaaatctttccatggtcccccaccacataaggacatgaccaacttcctttgctagtcatccatctctcataatcctctccagcccatctctgcagcctcatctccacccacacatgcattctgctgtaacaaatggtgggcaggcttccaaatgtactgtgttcccatgaagttgcacctttgctgatgttattctctttgcctgggtcccctccccatctattcactcctttctgcacttcacccttgctcttcttgtgccctaatagctcctccttttgtgacacatcaaaaattgcccactgtaggaagcccctccaagactaagagtgcctctctctgtgttcctgcatgtgcttttggagcccttatcacacagttgctctagaattgttagcttgaccacactgtgagttttcttaagggcagggacttattcctctttgcatatctggaatcttacccagtgtttagtacatactacatgttcaataaatatttgttcaatgaatcaatgaattgataggttttcttttagtagaaggaataaggtacattttttttagaacagcatccgaaaagcaagcaggaaaaattgggacatctttgcttaaggtaaaaatgcttttatggggaccacctttgaaactccatctacttggatccttttagtcttctttatgagataggaatattaattcttagatccaattaaagaaggtctagttaccaaggaacaaaacaaattggtatagaatggactttcttataagagagtcccaaatcatagatcataaggacaatcttatgttgaaatgtctcaataacttccaaatgccgatgtgaatgatatcatcaaacagtgtgagtcaaaggaagaaatgggattcctaagttttcattgtactccttgactattttattggtgtacagtctcttgacaattattttctcatcttctttcccaaggaaactttagatttaatatgtttattctgcaagatgtttggagacaggtatacaccctaaaaccaccattacaatcaatgccataaacttattcattgcctccaaaagtttcctcccatctttttgggtttttttgttttgttttcctttcatggtaaggacacttaatataacagctacccttttaccaaatttctaagtatacaatatagtattgttgattgtatacttatgttatacagcagctttccagaacttattttgcaagactaaaactttgtaacccttgaccacatctaccaattcccatcttcccccagcctctggcaactaccattctactttctgcttccatcagtttgactattttggattatacatgtaagtgagatcatgcagtatttgtccttctgtgtctggtttattccacttagcatgatgtcctccagttccatccaacttgttgtaaatgacaggatttccttccttttttagggctgaataatatttcattgtatatgtgtgtgtgtgtgtgtgtgtgtgtgtgtgtgtgtgtgtgtgtgtgtgtgtgtgtgtatatatatatcacatttcctttgtccattcatctgttgatggacatttaggttgcctctgtatcttagctattacaaatatgctgcagtgaaaatatctctttaagatccagatttcagttcttttggatatataccaagaagtgggactgctggatcaagttacttcctgtttcgaaagtagggcaccctctggacatttctacaactgaagtgattgattcttacttttggaagtcaggctatttgttggaatggtggggaaaaaagctagagcttaaaaataaatctaaagttggagaggggattattactgatggatgcattaattcaagggttactgatactctaaatacatttttaaaagttgtttgattaacaagtcaaaacagatggtttaatgacattttagagaggtttaatagagatccaactgaattaacaaatcaccatggtgtgcagaatattgaaaattcaccactagtagatttatggcatatttctgggtatttcattcccatttggtttattatgataaatcactgggaaacgggtagcctgtaggacatgacagcaaaccacactttggcaggaccagcatcagggctgcgtgcttttttaggaggctatgtagtctagctagcacagagtgacccagtgagagcttggttggctaggactttctggtggtagcccacagagctcacctgaaagagtaccaaggatgaaaatatcatcttggctaattggtctgctagttgatttaaaaaataaacaataaaaaaaatttccagtgtattttagcaaagtttaatattttgaagggggcagaaatgtagcatattttgggatcttaaatctgaatttgtgtctttttccagactttgtcagtgtctttgtctctctctccctctgccccctccatgtctccctccttccctccctccttctctctttcctttcctggtaagtatactagaaaaaagtatatttttttctcattttttttaacttaataacaacagcaacaatgacaacagtcaaactcttgaattctggtcacaatccagatcaataattttttccttgtagttaccttggaattaggttcttagcccctcactgctctctgtatatttctgtacaatattcatcagtttaaataagtacttcaatttcataccaaagtgccaagactatcctattttcactcatctttaactttcttctttttcatttcccacacccctgccattgccaaacaaaactgattatctctgtttttatctttcttttagactttttaaggcaataaaaaattggcttgctcagaaggctgatacactgagtgttagaataacccaaaggttagaatgctttggtcaacttatgggtatttttgatcacgtatatccatttttaaacctgccattcatgatggatcactgaccctggccctggccctgacccatctcaaaaagttactagcatgattactgattaacacttagactgttggcttgaagtttagtagcctgaaggaaaatttccagaggcattataataaggaagtttaattaagagttaatgttgactcaggaatattatgtatagcattgatccacagtgttgctaatgaattcattatgctgcaaatgcaagtgatttgttagtacattggccaataaaagtgaaatctgtctcaacaagaatgttgaaagaaagaaggcagtgaaactttcatctccactgggagtgaactaacttgccaaatctgggtcatcaatcatagtaaaatgttcaaaacaaataatgcatctttcatggttcactgtattcatcagcacttttgaagtcaccagtctagagtagtcgcctttggccaagttttcagtagcctgtggtttaggcaataagcctcaactgtctttctcgaggatatgttcccaggtggttgtactccatgggccattttcaatcaaatctgaaaggacaaaagggcagttctgtttatatgaaatgacatcatattataacctcaaaattgttgtcttaaaagtcaaatcattatctaaaaggtctcttagaattacttagagcttgaatgcaaaagactgaatttcccactcacgtacttcgccaacactcattacataggcaaaaaagtatagtaagtgtcacttatgtgagcctatgtatgtatgtagtgttatagggggtgggggtggcaggaaagacagctcaaatatgaaataattgaattattcattgccactgttctgattgcctttaaaaaaagttttatctggaagttatttcagacacactggaaagcttcatgggtagtgcaaaaaaaaaaaaaaaaccacatgcattcactcattgtaaacattccacctcatttgcagtatcactctatgtgcacatacacacaaatatacatacacacacattgtctttttttctctgaaccacctgagagaaaactgcacacatcatagccctctatccctaaactcctcgatgtattcctcccaagaacaaggacacttttctgtataactatagtctcaaacatctgattgcctttgaattttatagcatgacttatttatacctttttacttcgagttctaactcagatactgagctatagaggaacagctcaactattagttgagggatagctcagatgtctgatggaaaaaagtcacatcagtaacattttgaattctgcaaatatacacaatatgccaatgtatgggagataactaaatactggttttagagaaaatagatgagttaatacaaatagagattccccttaattaatagatcttatatgtttggttatatgtcttatccatgctattatagctagctagcattcattaggacagccagagaatcttgtctttctgtatttttatactgtttttcttcttctgatcagccgattccaggttttgaaagaatgaagtagttcctacttagataatgctattgccttgctccttaacagtaagcagtggagaagcagagtggacgctggtgatgctgcctttagtcctggagggagtgtcaaccagtgggtaatcattctgaccctgcaacacaaccatcccttcactatttcagtgaaggtctctacttcggtggtaggtctctactcaacatggtacttatagccgttttatacttgctatcttaaaaaaatatgcaggctttcactgctgtgaacagataattgatatttatgtttcataatctgtgaagatagctaacacatttctgacagttgcaattttttttcccaaaacgagtttgagcatgcctatccctctctacccaagtatatttaacagcatttctatctattggggaatctgagtgaggatgacaacgtgtcagggattagaatggacaggaagagtctctgtaagaggagggtgtgatgctggagcaatttatgaaaattgggtcccctggtaactgtagtggatgttatacagacagtcctgcagagtcatccacgaggctgactcactgacaatgtacacatagaggtgggcctcgagtgtgtgcaaataacaagtttactactgcaggcaaactcttcgtttattcatttgacagatttatattgaggggcactgttctaggagctggggatttggtaataaataagatagtcatggtccgtaacctcatagagcttacacataaactgttttgctttaaaatattgtacattcagaggtgtttgtgctccgaccatatgactgcaatatgtcatttgataaacctttcaggcatgacttggacccacccagaacttagctttaaagctatcagattgacaggaggagagaacactggctttagatgacaaatcatggaaataattatgaaaagaccatccagtttttaatgactttacaagaatagtgttcttgtgagactattgaataagaagaaatatatgaacatttgtatcattcaactgtctaactgataccaacaccaataaatatatgaacatccttattattcaagtgtctaatgagtgagggacagtgcctgtaggaaggagagcctcccaacaatggaagcagtgttattcttcatggtagggagaccattttttggttcctcacaatgacttccaggctggaatgatttccaagtagggcagggaagacaaatatctgaagcctaagggaagctccagggtgattcttgtagttttgtttggcagactttctaaaaagcattgtcagatagttttggagcaagcagtttagccatctactaccacacaatatattcaaatcagagtaagctggaagaaagtcatccaacatccaagtctcagcctggcctatgtgaacatacttcttcttaagactaagctgtaggggtactatgcttattacctcggtgtgaaataatctgtacaccagcaccccatgacatgcaatttacctatatgactaacctgcacatatacccctgaacgtaaaatttaaaaaatttttatagatatgttaaatttgagatgtttattgaacatcaaagcaaaaatggtgaatgaacagatatatgacacaaaaaagactaaggtataatcctatatcatgagtgaataggaattttttgttattggtgtttgcgttagttgagattttattcagcagtaaatagagagatttaaaatagaagtggcttaaggaagacagatatttctccttcatgtaaaatctgaaagttggcagtccgaggttaatatggcacctctatccagtacagtcttcaaggacacgtgctctttccatcttattgcactgtgaggtgtagcctctgttgctaaattcaactcaccatccaatatggctgctccgactccagccatcaacttcacattctagccagtaggaaagagaaaacaataaatacaggcagataaaaagatagatgacaaatttctcttaagggaagtttctagcacatcatataatatctacataacgcttctactaccaactcattcaccaaaacttagttatatggcaacacctggcaaccaaggaggctgtgaattttctctattttgggcagtcacatgcttacatgaaaacaggtatttgaaaacaagtgatgaagaaaagcatcaatattaggggacatttagcagtctctgccacaatgttgcctattaataatcctgcatacattttaaatatttaatatcagtctgcaacactctatttgcaaggtaatgtatagtataatctttaccatatgaacttagtagccatggtgttcaggaaagttgtgttattttgtgctagaatattttacctgccctaggtaagggcctaaagataaaatgtgctagactaattaattttaatggcatatagcaagagatttccagcgttaaagattgcatctccacctgcaatttgggaaaggaaaaactgatagcacaaaataaaagtagtgggtgtcctgaaaactgtctgatgctcttcatgttcttaccaactcatatcctcatctaaatttgaatcacaggtacattctgaccttgtcgtagagagagtcctaaagtctcacgagagaattaccgtgcttgttctaacaagactgtgttccagcaggcatgccaaaatttgatagctacaaatagggagatttgaaaggaaagaggtgggagaggtaatttcttttaactcaactgcatctggtggattaaggtagacaatattaccattttgctgacagaaggcagacatggcactaaagagggagaatgagcaaccacagagctgatttaatttccagtggggtttatggaagcaccaaaacatgatgtagccaaatgttcctaaaagtatgaagtaatttaatttgttccatcattacaagaaattaaagccaagcacaattacatcccagtagtaaaaggaacccgctgaattgccattgttattgactaaatgaagtgagatttctgattaccttgtccagcacattttaatttctgtctgtccatttattccaaatcacattacagggccttaactgatcttgacaaaataagctacattattaaggtgcagtttaacctgagaagctttaattactagattagagttttcaaatgggcatgtcttctagacttcagtacatttagggatgtaattattagagattctttgtttctgatgtgcaaaagagacccaagtttaaaaggaagacttaaacttacggaagtgatttttttttttcttccaccaagagtctctttgtagacaggtgtctgttctgttgggagtggacttacacctcctgaatgctgtgattgagagagctgcctccatagtggaaagcccccggtagagggtagtacccagatttccaaggggaggggagttgggggactaaacgatgtacagtgaaccctctcataagtagggtgtctagatgatttagcattcaaaccagaacactttttagaatgaaaggcaatgctattcataattacactggtataacaggcatagaccttggaagttccaggccaattaggatgtatggactctgtacctataaggaagacaaggcaatagatatgtaaacaaatcaatgtgatagtcattataggcatctggagaatgaaaggctctataggacactgtgggtgggtgggcatggagaacagtcactctcttagggatttctctcccctggaacaaaagttacactaatcatgtgacatctcagagcatgaagtttgtagctccctcaaccatattcatattcctctaacagtccagttaatgattctcagatgcattagaaactatggaaatattatagaaaagaagccttaacaggggaagtgtttcatgctttttcagttccattcaacaaacatttattggatacctagtatatgacagccagtgtttagcaccagagatcaaaaaatgaattcattatggttccagccccagagaaattcagtctagtaataaacacataattgtgatagactgtttagtgatttaataacttaaagagttaacttctgatttggttctcatgcatcaaacataatatttgccagtctctatctctacaaggagccctggatttttcccagtcccctactaatgctagataatatggcaaaatacacaggctgatcaggctgttttagagactcttttaagcagagatcttttgttttccagactgctaatttatttttttctacccagaaagcccttcctaccatctgagctattctgaccaaatcagcgaagacaagctacagagatttaggatgtctgggctaaaaaggtttgcttgtttaattagataaataatttgagaatgctttccaggattactgttcctaaccacattgataaatgctgggaagactatctcagttatccagcattggataacagactgttggagaagagtgaagcttcagtgtgagctgggaaagatcccaaaaatcctaacatgctctaggtgcctgcatataaaattcatcatcatagtgactttaggaccacttgctatttttcaggcactgctttacatacatagtcctatttaaataattttcagaatcatactgtgatataggtactgctttctccattttataaattagaaaacaagctaggttaattcacttttataaggtgccaagctagtcaatcagtggcaaagctcagatttggaaacaaggactgccttactccaaaaactgttctcttaaatttcagtgtttgtaaggtccctcactgccccagcataacccagcatttggtccattcaaggattaagaggaacagggatctgccagccttgtttctgcagaaaaaaatgggggaggcagagctggatctaaccaaacaggttaaatttaagtgccaggtttccgtgaaggagaattatgccagcaatggtttctcaccttaatgaattcatttctaaccattctttgccctgcaaagacagcaggatcctgggtccacagggcccagttcatggagaggagaaagaggcacataatgggagcaaaaagtgaagaattcaagctgcaaaatgtaacggaattctcaaagtgctgggttctcttcactcccttatctggcagctcctgttttttctcctttgcctcccacagttgccactttaaaaagtcatttttaatgtggcacatatacaccatggagtactatgcagccataaaaaagaatgagtttatgtcctttgcagggacgtgaatgaagctggaagccatcattctcagcaaactaacacaggaacagaaaacgaaacactgcatgttctcactcataagtgggagttgaacaatgagaacacatggacacagggaggggaacatcacacactggggcctggtgggggttgggggagcaaggggaggaagaacattagtacaaataccgaatgcatgcgggtcttaaaacctagtttgggctgatgggtgcagtaaaccaccatagcacatgtatacctatgtaataaacctgcacgttctgcacatgtatcccagaacttaaagtaaaaaaaaacacaagaaaacaaacaaacaaaaaaactcctttttaaacattgtctcagcgtccagtcggttgagtttctgcacttttagacactcaagccccttctttcgtcctttgctccagtggttgtagcttcctacctccttcttaccctcacccctaggcttccactttagagaatttggagaactggggaaagaaaagactgttttgtgcatggtgtgcctgcagcctagtgccatgagctggttcttgccgtgtctgagccaccagatccactccttctgtggttcacacgctattccctctatcccagccaagcttgcaaactctgatcatgaactaccaggtggaggcggggcatggatatcctccccaggaagcctgtctggaacctctgaacttttctgacctgtgcatgcctctaccacagcacaccttaatttcttttgaaatcactgcatttgttcatttgttagttgtttgcttctagatggtagacgccttgaggccagaattcttctgaactaagctttggaagttgagcacctcatagaataccaagcttctcgtattactggtggggttcaacaagtatttgttgagaagtgatgaatcaagctaaagtttaagtaggcaaagatgaatcacgtcataacctctggtttcccaactttgtctatagaaaaggctccttgctaggtaaaacaaaaacagaagaagtatgtggattctcttcaactttgggactcatcaccctgaatctctcagttatctcaagactgattccctccaccctggagggcctccctgcccctcctttgtacagcagtgaaaggcagaaattgaatagaaggagggaaagagggaaaaaggtctagatgatcaagtggcaaaaacaaataacccagcatgaacaagtatgcagagagggaactctgaggaaacttgctgacaaaagatagagatggaggtgaggtcaaccacaggggaataatgggggcagacaagtctaaggaggtagattttatagggacttcgaatagatgaactgaagtttggggaagacctaaaggcattaaaaatccagtataagttcttgattaaggacagatatcataataattattattataatacaaggggtgctttgggaacataggctatgtaggagggattgacagaggaagggaggaaagatctaggaaaatgagggccaaacggaaaggtgtccttctcctgttcatttgccaatgaaatgcctaggatatatggtggtctgctcctaccctccacagttctagccactgcaaccaggatgcccagcaaccatgtcattcattcattcatatggtctatctgtctcctataggcatttcagtgagtggccgctgctttatgtgttctgttggtaaacttgtagtaccctgagaaaactcacacattatggagaaattacttcaaaaaatatgcacagtagttaactgaaatctttttatgtgttctactctcacgtgaagtagagaagtagagggagagttttttaattataaaaagggaggaagagggaagagggaaacaaaactaacatttattaagcaaggtaatttcttacctcagtgttttcaaaccaattggtagatttcaaaatcaatttaaggggtcacaattaatactttaaaattaaataaaatagaaaacatcagagtgaatcatacatagtaaggataaatgttatttcatgttaaattatgtttcaattctctgtattggctcgaatatatatttactcttatgtgtatggtatatactgttcctatatatacatttcctttttattttatatatataattctttttattggtttaatttatactgaaatgcatggtttgttaaagactgtaaacaaattttgccatgactattatttataaaacacaagagtttctttaaataggagtccactgctctcctctaccttttaaaaataaatataggtataaaacctttttgtacattttttttatattactgaaagccagcatccacatgccttcaaaagtgagcacctcttactttaaacaaatctaccaggttatagtataaaatataaattttactgtagtttactgtcaataaactttgtaagccactgcttcatttcatttaaacttccccaaaaccttgtatgagtggagtctggggattcagaagaagacggtggtcatcacagaagttgaaattctctactgtttacttcttttcaaaggtcttgttagcggtggccttgaaggtgatgaagaaagacactttcaaggtggacaggtataattattgggtcaccaagaacaaatttgaaaaacaaaatatgccaattgaaattagcatgtagcacctaaatacccagaagcttcttcattgaataatttattcattgaataaattatgtaaactgaattagtaattcctagtgaaatagtggatgaattgagaatagtggtattggtaaaaatggaaaaaaatttttttcttttgagacagaatctcactctgtccctgaggctggagtgcagtggcacgatctgagctcactgcaacctctgcctcccaggttcaagtgagtcttgtgcctcgcttgaggcacaagattagatttagtagagatggggttttgctttgatggccaggctggtctcaaattcctggcctcaagtcatctgcccacctcgacttcccaaagtgctgggattacaggcatgagcgaccgtgcctggccaaaaaaaaaaaacaacaacaaaaaaaaacaaaaaacaaaacaacttaattcataaaacttaattcaacaatttaagagttatacttcaagaatgaagatatataatgaaaatatgaagtcttcagaaggacacacatataataattttagtaaatctcaaatttgtctcaaatcaaaaacttgctacacatatttttgtcttaattatcataattaaaaatgtctacacattacataatactatctagtaaatatgccctagagattgtgtgtgtgtgtgtgtgtgtgtgtgtgtgtgtgtgtgtgtgtgtatgtacacccattatgttttcagacaattggaagaaaattgttaggcaattgtttttcttttatcaaggagctgtcatttaagtgcaaagctggagtattcaaaataaaatttgggcttacaagatcagggcatggcaagacctatccagattgctgtggaataatatatgcttccaaacgctaatcttaaggatgaaaaacacataaatgacatgccttcttccccttgcttaccttagtgactacagtttaaataatctaaaatagcagataccatcaatactgttgctaattatgctacttttcagagaggtacaagagtccttgtacctctagtagtagtgataccactactagtatcaaaaatacaagattgttttgttaattttgaccatgttttaaaaaaagatagggaggagatgaattactattaaaagcagctcttatattttacatgtaatagatgataattacaagtttttaacaaataacacatttaagttgaactgaaccgccaaaaaagatagagatatgaatatatgatttttagattaaagttagttttaacattcaaataaagtgtgggaaaatggcctggaggccaccttctagggaatgtatttttagccctattttacaaaaaagaaaactgaggtacagagaagttaatttgcccaaatttgccccatggttgctaagttgcagagccagcatttgaaccactgttcccaagtcatactctttctattgcttgtaactgtcatcgtagaccactaaagtggatacctccacaactctttgctttccactgcatctggactaccacaatagctccttagtctccatccttctctcttctccattctatcctcttaggctaccagtgcacttatccaattcccacaatatccactagctcaaggccacacatttaagtgttcaactctatatcccttctcctccctggaatgtgtctactccacccagcccatttactgtccacacatacaacctttattcaggctgcagacatttcctacacctgaaaacaatgccagcggactccctcctcccacagccattaaaaccacagtcttccttgaagacctacatccaagttcaccttcttcctgaaacccagcacactgagctatagtccatacctccctctccctgctcgaactacagtagcactcccaggctgaatgatttatatgctaccttacactgtctctaggcagcagccgatcatgtgtctgattttctcagcaggttattatggttccttcctgggcccaggctgctgaatctttcatgttcttgtatttcacagcaactatcacatcagagaggctcaataaatatgtatggattttttgactattctctttcagggggaaaaagagagaaagaaaagaagaaagggagggaggaagattactctctgaccatttctcgatagcatacaaagtcaggaggaagagaaataaaatgtcgttagtggagatttcaaccatatgggaacctactaaacacatgtatttgttaatgttttggagttacctgacatataggtataggtataggaaaacctattccaggtattcttcaagaggtgatagttgttgtgtgaaaaatgcattctaaaatcaaacaggtttagataatgcttgttaataaaattaaatatctcattttgctgtggaccttctagcttttggtaggttcgtgtccattagaaatcactgtaaaaagcctacatatacaatatttcccaagcttgtttgaccacaaaacgtcattagtaaggagaatcttataaggacaatattgattggaacattctttgggaaatgtttgaaatgatcttcccagtaacctcagtgtaagtgatgctctgtcattaaccaatgacaaatacatattcttcctacatagttgacttttcatgatttggtgtggtcttgtaaaagctattctattttgttgtttgtttgtttttgagacagagtctcactctgttgcccaggctggagtgcagtggcaccatctcctccacctccagggttcaattgattctcctgcctcagcctcccaagaagctggaactacagacatgtgccacacacacctggctactttttgtatttttagtagagatgcggttttgccatgttgtctaggctggtcttgaactcctggcctcaagtgatctgctcgcatcagcctcccagagtgctgggattacaggcgtaagccactgtgcctggtctaaaagctattctaaatcataggttgttcactcacatttggctcagaactggttaatatttgagggttgatggtgatgatggaaaaatagtaactgttttaggattgagaatctgtggaaaaggaaggaaactctcaaatattaactaccttatttaaaattaacttatttaaacaactctgcaaagtggttcagtatacctactattgattgaataccttctatatgtcagatacagcccttggtactttacatttcttatgcatttctcataataaccctgtaattctcaatgtatacaatgtgctcaggtcttttaaatggcttatttcagataatacaactagaacaatggcaaggctggaattcaagttctgagtgactcaaaagtccatgctctttctgatctatcacactatttcccatgaagagctcttataggttgtggattcttctgtgtgtataataactttcttagccaaatctaaatctccatagatattcttgtaaaattataaaactaatttatcttattcgtgtatggagccagttcatatacaactggataagccaaatataaccgatatactcttgagttctgaaatttgttctctataatgcacacacagttaacaaatgtaggtttaccagtaggccaaaatagtttatcactcatatgtgttgcttgtaatgcaagtaatgagattaaaaattgtacataagaaattacctttctgagactctgttcatagcctgtttaaaagggcctagtcttttcgggaaatcttttgtgtgttttttcttttctttttctctttttttgggacagagtttcgctcttattgcccaggctggagtgcagtggcacaatctcggctcactgtaacctccgcctcccgggttcaagtgattctcctgcctcagcctcccaagtagctgggattacaggcacccgccaccatgcgtggctaatgttttgtattttctttagtagagatggggttcatcatgttggccaggctggtctcaaactcttgacctcaggtgatccacctgccttgggttcccaaaaggctgggattacagacatgagccaccatgcccggctgtgtgttttttcttaatcccagtcttcaactggacaaatgtctctttggcattacttcttaacccttaggtatctcatagtgagagagatataaatgctaaacagagatttatgagaaagttaaaaaaaagaagaagaagaaagcagagatagcgattccgaataaaagattctggggcagtgttgattaaaataattgctttcttttcttcactcaggaaagtattcttaacttggagtccttggtgacttcagggaagtcagtgaacacttttagagtgaaaaatattgataatatgaacttatgctcatttttctgggggtgtttgcatcagatgcacctttgtgcattcatctgtttctcccaaacatcatactggtgtattggtgaattcttttaaaattttactctattttgtaaggatcattacatatgaatgatataccataatacttgtcatttttattttaatgttaatatttcacttcagtaagacaccatgatctgcttgaccattaccaaattttggcaatgttagttcctaatactcttttaaaaaaagagaaagagtttgaaagcaaaagactgagaacaagagatagacgagggtgattacatgtaggaagccacacccaggccagtattactgtttgaatctcgtttggaaataaatattcttatctgatagaaaacaagcatacttactgattattcactcacaaatatttgctgagtgcctgtaaatgtcaggaattttctagacagttatagaaaggcctagacacaaatataaaaatgacattagaaaagtcatacaggcagaagccagcaaattatttccaggtggaaagattggctaagatgggcagtcttggatgggatagtcttagatgtaaataaaagggaaaggtattgaaaagcagccgaaaaaggcctatgtgaacagaagtgtgacattaatacaataagtaggagagagttgtgcagcaggttcttaaaagaatgaaacaataaaaccagggtttaaggaagattattctgactttataaataggactgtgttgagaaaaagtgaatccaaggagatccagtagtagaccattatatgaatctagaaatacacagatgagaatttgactgaaggtgacagttacagaaattaagaagaaattggtaagtcaactggcaaagtattggatgggaatatggtaggggtaggagtggagataagcagagtgagtgtaaatatactccagaactttctatttattaatagctttatttctgagaatacctcaatttcaaatagaaaacatgtacccctgaagaacagttgagctaaactcacagaattccaggatcatggtattggatgggatccttgacaagtaactggtcagtttaggaattccctctacaaacatagctgaccccatccaggctaactataatgaacaaccttaaaaccaacacctaacccagatagtacaatttcagaaatcagataataaatgaatgttagagctgggtaggtgctaaagataatctgttcaaactccttgttttctctaaggaatactgtatgcagtaattgacaaaggtgaagaacaaaagactgttatatcctaagattgatagtatatgatggaaacacagatgctctcctacagtccccccagggaaataaaattgattcctaaaattacaacaagaatacgtaaatagcatacataattgtaactttttttaaacctgtttgcaaaaattgtcctgtaactttgttcaaacaacttcccagacaaaagcttcctcagtagcattctttaacaccctctttagtcttgtgttgctgaaatatgtgtttggaatgaaaattatcttagcgcaaacctgtgggtatatacggtctgtactgaatatcaatggcaaagccttgatatttgtcttagctcaagctgctataacaaaataccataaactgatggcttaaacaacaaacttttatttctcacagttctgggagctggaagtctgagatcagggtgtcagcatagtcaggttctggtgagggcatcttcagggttgcagactgcccacatagcatgtatccacatggtagaaagagagcaacctctggcctcttcttataatggcacgaatctaattcatgagggctccattctcatgacctaattacttccgaagggctttccctccaaataccgtgacaccggggattagatttcagcatatgaatattggagagacacaaacattcagtccataacaatattttcctttgacatttcctttttctttgctcctgagagtttttcctcctaactttctgcagcttctccttccccttcagggactgcttaggattttctccttatctggtcaccaacctcttaactggtctttacttttctgatctgcctttatactattcccagagtaatctttttgaaaagcaaatctgaccatgtgacttcctcacttagaagatttttaatggcctctttagaagaaaatattgtcttagaatagtatacaagtcctccaagactagttctccatctttatctttgtccactgtctgatctaaactttatatccctacctgtttgtagcttcctgaatggcctgtgttctctaagtgaacttcttcagaatgaatccctgttcattccttgaaattcttttttctttctaactaccctaaaaactgttccaggtaactattaagtttctggaccccgaggttatacctaggtattagttgataggctcactaaaattaatagaatgtttgcatttaagttagagacttgagtccaggagaaagtgaagatacaatggaggaggaagggaaaagaatctattaggcaatcaatgcaagattatttaactcacaacctctcacttgaactaaaataacttacaaggctcttgttattatctccaatctataggtgaaataaggccctagaaagattagtagctgaattgcctggaattgcttgtatgaagtggaatagagattggaatctttctccactcttccagtttctttcaaagaataatatcactcacagttgcacacatgtcacatgaagcccccaacctagatgcctaattaaacttagctcaaactccaattttttggacaaaaggcctccttattcttataaaagctttctcctctttctttgactcttctcttatgtcagctcagagagacatttctgcttgggccaatctggccttcaagctcagtcccttcaatgaataaaacaaaacaaaacaagtcgggattttgtaccttcagtaaccttattgacgattgggagaaagggaaaatgcacgggttggagttaccctttagaccaagctgactcctttctcttatatgcacacacacacacacacacacacacatcttcaataaccttattgatgattgggagaaaggaaaaatgtacaaattggagttaccctttagaccaagctgactcctttctcttacacacacatacacacacacacacacacacacattctctctctctctctcactctttcatgcccttacatacatgcacacacagagaccaagctgactcctttctcttacacacacacacatgcatgtgcacaaacacacattctctcgctctctcatgcgcttacacacatgcacacacatacatattccctctctagcaactggcatattcctcccctttcctgtgtagatgaggcacagattagttccacccaaaccaaagctcttcaaagtctcaccttctgtcataaatagctttatcgaacattttaatgcaggcagactctcgtgaaagaaattctggtgaattccattgtttttttctccatcttattacagtatgattaataagttagtgactacaaggttgtagtttttaagagcaagaagtccactccctttcaagtcacattgggcagtccttctgttcatacctgacatattgtgggaacatatgtctgcgtaggattttaatacagagattgtcttagataagaataatcgtcagagaagcaaatggtctataagttatttaattttattcttaatatggtcaaagataatggttgcactgacttcaactttactttcttaaattccattaattgcatagcactagaattttccatataaaataaaatcagatcccatgtcacacagtactctgagtcactctgtgactcctactcttgaagatatagtcctacctgcagatgcctgacatggccagtctttgagatggccagtggctgaggatttctcagatttctccagaatctgttcccctaagcaaggccctactcatggttatttcttttttgacacacacatcttttttttttttttttttttttttgagacagagtttttatgctcttgttgcccaggctggagtgcaatggcgcaacctctgctcactgcaacctctatctcccaggttcaagcgattctcctgcctcagcctcccaagtagctgggaatataggcatgtgccaccaagcccgactaattttgtatttttagtagagacagggtttctccatgtggatcaggctggtcttgaactcccgacctcaggtgatccacccacctcggcctcccaaagtgctgggattacaggcgtgagccaccacgcctggccgacacagacatcttgttcatcataggtctgtgtgcttgctcatcttttctcttaaaaatccttcccactctcttttatttcattcttgaggactcagccttttcccactccacctctgtccctgtctgatttaaatagtcctcttttactgtcccatagcccacatgcttccttctgtgagagtgcactctacagttgtttgctgaaattacctcctctgctggactctgggtaagggacacactcttttcatcatcttgtttctgcagcctctaataaagtgcatggcacatagtcagtgctaaataaatgttgagttactggtgggactaaaagtcaatgaaagccaacctcatgtttatttcatataaaaattctactagaggcataggcaacattcggaaaaacaattgtagttagtgagaagataaaagaaaaagaaaaccgtcacaaaattgcacacatctttcctttggaagctttatgaagtactaaataaagttttatatattttatacaattttaaaatacttcaaaacaataatttgatgccagaaatacacttggagatgagagcagcttgccactagcaaactctgcttaaacctattacatgtacacattgaaagagaatccaaagccttcatgtatttcccatcagataaaatgtatagaggaaaaaaaattaagtcagcaaaagttagacctaacctacacaaatcttttactgtagcaaactaaaggaatgactagctcaaagcaatacacggtgaaacagaaatcattttttccagttctatctactgtagacagtatcaattccttccgtagaacaaaggggaaattttgtaagaattaagagaagagaagctggaactggttagggagatttaagtatttgctcttaggagctttttgttgtagttcttttatttttaaaaaatctggatcagtgctcatcatgactggccatcagagaaatgcaaatcaaaaccacaatgagataccatctcacaccagttagaatggcaatcattaaaaagtcaggaaacaacaggtgctggagaggatgtgaagaaataggaacacttttacactgttggtgggactgtaaactagttcaaccattgtggaagacagtgtggcgattcctcaagggtctagaactagaaataccatttgacccagccatcccattactgggtatatacccaaaggattataaatcatgctgctataaagacacatgcacacgtatgtttattgtggcactattcacaatagcaaagacttggaaccaacccaaatgtccatcaatgatagactggattaagaaaatgtggcacatatacaccatggaatactatgcagccatgaaaaaggatgagttcatgtcctttgtaggaacatggatgaaattggaaaccatcattctcagcaaactatcacaaggacaaaaaaccaaataccgcatgttctcactcataggtgggaattgaacaatgcgaacacatggacataggaaggggaacatcacacaccggggcctgctgtggggtggggggaagggggagggatagcattaggagatatacctaatgtaaatgaggagttaatgggtgcagcacaccaacatggcacatgtatacatatgaaactaacctgcacattgtgcacatgtaccctagaacttaaagtgtaataataaaaaaaatctggatcagttgttataattttttttgtttttttgagtcggagtcttctgctgttgtccaggttggagtgcagtggcccaatctcagcttactgcaacctctgcctgccgggttcacgccattctcctgcctcagcctcccgagtagctgggactacaggcgcccgccaccatgcacggctagtattttgtatttttagtagagccaaggtttcactgtgttagccaggatggtcttgatctcttgacttcatgatctgcccgccttggcctcccaaagtgctgggattacaggcgtgagccactgtgcccgacctcagctgttataatttgtattttttttttaaattaagggcatacaaatagtgtccaaaataagtggtattttttggacttgttctcttcatgtataccaataggtctatctaggaattatgacaagccgatacagtcctttagcagaccttcaagtgttggcaaagaaactaatgtccacatagttacacatcccgtacagtggatccttttacctcaatggtcaacatcactgtgagttgtgggtaagagtaatggactgaacatttcacaaaaaatgacctcaacctctagctaactgctgtggctctgaggtgattacttttttcctttttcaaaaggaagctgcttcttcagcatcttctcctggagcccctggcacagtttcaggccatgtgtcaggggaacctctaagcatatcactgtgacagaagccaagtgctggcccgcaagaattgaggactgtttgttcacagaagagcctcagcagaatgcgggtgttacatagttcaaaggtgccttgaagaaaactgatgctgttgtagcaggggccttcaaggctcaatttatttctcagttgctgttccatagccctctcccagcctttagggagtttagccaatagtttttgcttgggtgtttttctctgtttagttccttgacttagcaagatttggtgcagttaaagagttttcatgtatttttaaggagagccacagtgtatactactctggcaggggttgaggggaagtattttattaatgaatgcagtatgtgttcttggtaaaagccaaaattaaactggctcactgtttttgtcctgctagctgtcgacatttaggtgtgttgcttggtgtggtgactcaatttcctgtgggatagttggcaactccactttgaggtttgttcggcgggatgaaaaggtcagttacttgatgtcttagaacacttggggttaaaattcctaaaagtgaagctttacaaatgatcctgaaaaatcgtggctagctatattgcctactcacctaggaatttggaaaaaagcaatattctcagctctatgctaatatcaagaataattctttatttgagcaacagtttcacagagcaaactttactctgttagtaattattttctcactagcatgtagatgtgttccagtgatttttcatttttcttatttatacagatgttagaacttaaaatatatgcttaccccattttatcatcatactcaaatcctgtctgtcaaaagtggctggtgcatggcttggacataaaatggatattctgaagtaaattgttcctcctgtcactatactaccttcttaagaacaaatcctgtgtataaagtgcatgatgtcttgaagcattagccaaaactttcctgaattattttccacattaaaaaataacaactgaaatataatgtgtggagccacatcctgttagatttgaagcctgagtctgaacagctttgggaacttggtgaagatggaggaagggggcagtttacttagctactgggaaatcacttgaggctcaggctttgagaaagttggagtgcaggggagaggagccacagaaagccgaacctcagaggggactcccagcttcattgtaaccaatgattgaaaagatggcactgaacaaatcccagacacaatggttatgcatctttaatccactggataggctaactatggacagctcaaatgatcataaaacaagtcaatgtcctcttaaaatttcctacattcctatattatgggaatgagagagagaggaaaatatcaaaaccaaaccatatagtagatgcactaccatggcaactaggtgatgctatacttgcatatggaagttattcagtaaaatgaaaatgattgtgttagagccataggcgaaagtattgtttgtgatctttagggtgtggggttacaatggacttcctatatttgtgtgtaatgcttcaatttttataacaagcatgtaatattttttacattcttagaattggggaagctatacagagcaggtattttatatttaccatttaaaattattaatatctttaagcttgttaagggggaaaaaaaagcttcaatctgaaactttaattcacctggcaaggtttaggcagttgtttgtccatctaaagtatatatttacatagactgcggggtggaggaagtagaacaaaaaagaggcaaattttaacctagagtactcaaagtgaacagtaaatagttcaagtattcttgataacaataagccacgtggcacatgtaacaactactttaaaagttactctaacttttacaaagttcacataaaaagctatctcaaaaatcccaggagcctaaattcagtccatgaactttatttgttgtgccatgttaatttatggagtctaaatttcaagggcagaatttcttctccaatacctgtagattcaaagacaaagacaagggatcccaccacttagtgtaagtttctcagtatcttctttccactcgacaatgacaaagttttatcaaatggacccttgggagtttgacttctcctcactatgaatggtttgcttattgcatgctaatgtagaaaagttctcccacaactgatctgcttagggacagtgtccctggtgccctgggtcagcctttgtaaacagaacaggcttttctgtatgcctttgaatatggtctttccgttttctcaaaattgtagtgtactctgcacatggtgggtagaaacacccttccagattttcttccttggcccaagatcatctaggtcttatgcaattcacaggggaaaggagtagtatgcaggacatgcgtaaattctccttaccatgtggttctttcacattgctgttcctttaagagaactcttaggcaattcggcatatgaaaatgcagcctattgtcaaatttgtgaattataaagcgttccgaccccacaacattgtatattttgtttgcttgtttctgtccgccccaacatttagaagtctggtacttagtagggactgggctgggtagaaaaagaatgcggtcttaattcccacaaccctgcctccttgaagtaggtgaatcctaagcctttagaaacgaacccccagaaaccctaaaacttaaaccctcagaaaccttgagggtcctaaataaccttgtttgtgaaacttcgcaggaagcagccggtcgtggagtcgcagaggctccagcggtctgggcaacctggagggcagtggctcggcggggcgcgcggggttctagcgagacaggtgcgcggccgtgcgcgcctgcgtgccggtccctcctgagccccgcggcgggcgcgaccccggacggcggactgcaggcgctccacgccgggttttccgccgctctcctagcacagacagtcccacagcagccccacagacacacacgctcgcgcccgcgcctcctcgtctgcacttcaaagcgagtggcgcccggctgcgccggggggatggcactgcgaggtggcggggcccccggggcagagctcgaggggaaggacgcggcgggtggcacggacagggacaggcttttgcaattcggaatcttttcgtaagggggttgaggaggagccaggcagcgccgagggccgagaggggcgtgagggggagtgttcccggaaagctgcggcgttggagccgcgctgcgcctgccgcccgaggagttgagaaagaaaacaggaaacgtggtggccgcgcacccggccgcggctgattcattcacttcaagtgccgtgcagaaggctcggcaggcggggcgggcgtggggccgcggctccgggttggggaccgaggagatccggctgtggaccagacgctcctctgcggggcgggcacccaagcgcgctcgccaccccctcgccatccgctagagccgggctcctggactgggactcgggcccgccgcacagttgaaaagtcgcatagtggtttttccgctcgcgtcgctgtgtgaaagttggctcgccgctctttgcacgccctccctggaggccgacccgagacgccaagctggagagaccgtgcctccccgaggccggccgccccgcgagcacagcctccgcccccgttgcactgccgggctgggcaatatgaaggagcagccctcatgtgccggcaccgggcatccgagcatggcggggtatggcaggatggccccctttgaactcgctagcggacccgtgaagcgcttgagaactgagtccccctttccctgtctcttcgcagaggaggcctaccagaaactggccagcgagaccctggaggagctggactggtgtctggaccagctagagaccctacagaccaggcactccgtcagtgagatggcctccaacaaggtaagccccggttctgctgtcactggtgcccccaggctgctgattcccatgccggcgagccactggtacccatagccccgggaaataaattgagaggttttttaggcttactgcatgttggctattctgctccttagagggaggttcctgtttccttgctttgcctcccctagtcacgccagataaacattttccaaaagcaatttgacgtgctaaatttaagtatctcccaagacacagggttcctaagtaacactgagcccttgcagcagaaacccagtagggtccatgggcattgcatgtttaaaggtgttcttgggattcccggttgaaaataagaattggtggatgtctgtgaaatcacttgaatgtcaccacctagggcactcaaactcagaagagttcatcgaacttggaaccttcaccctaattcatctagttgtcagggtaccccgcaagaactgagcctttatatattcagttggccatacatatccgcaggaaacattaacagagttagaaggttccttatgatcattacttttgtttccattaatcttggaaagaaagcccagttttttgaggtcatttagtacaaggaggcttcaactaggcatctgtgccatatgtgctaaggtgctggtcttggcagttaatggagttttgagggctgagaagtaaccttcagcctgggacagccttaaaatagcacggaaggcaaggtatagtgttttcagttttgctgtattttttggatttcctgttctttttgtctttagttatgcaaggagataattggaattgtgtatgtttttagtggctatttgcctgtgcatgtcgtatgcagatggctgaaggattcagccagtaaggactggtaatgttgtgagacaattagtaatagttgcctcgtcaagatatttaagtatttttggccacctatttacaaggtcaagaaggttatattatcttacagttcatctatgtgcacatatctttaaatgagtgatgcttttttttttctacctttctatggtttttatcccacctgttctcatgcagtttttacaaaaaggccacggcataacagccacttgattgtcttatctattaacagtgcttttgtaggtagcattgtcaagtgaaaagttggcttcaaataaataaaaggggctctgtagacacggccagcagatactaacctacccatatgcacactgacctacccatgtccacactgatgatcaatttttttgtcatttgtgcctcatttctaaatttggcacagctcctcatcagaatgaccaattattgctctcttactgggacttttaccccctgctgtagcattaggcacctttattctcatctgagtaacaaattcttagttttataaaatatagtttgttttcataatttgattctcaatagcagtagacatatgctgaatatgtccagtgtcctaactgctaaatgggagcactttgccatgggcctgagttcttaattctattgtgtggttgattctgtgtaagaaaatgaagagcagaatcaaaagccacttagcaatgtgcaagcattagtgtatattttcaaggtgattcgacagtagtttttcagctaaatgaatttgagcagctagttactttccctaaaatccatattcttaatgttgagatctatgtttggatttaaaactgaatgtgaaatttaataatgtattgtaaatgacttcagctgtcaaggaattaatctatacgttaagatttaaaaattttttaggtcataataattgcctaaaatgattcctttcttttaaaggcaccagataagacagggatttaaaaaaaaaatctttattatgaaggccccagattagactttgagttaatttacaggtttaataggagaggttggtctgtttggttaaaatgaaatctaggtaaagtgagaagataattttttcaaaatgtagtcattctagcaatgtttatgtcttgtggctgaaaaattaggatattttttcctagcccacgacagagctgaattgaaaaattattgctgtcacactaatttttaacattaaacttagctcagcttaagctgttgcttaaacttttaatgtccaagccattcgtgtcttctttaacttatttatttctaaatcagtgctaagcttacatgactgttatagacaaaaaagggttagcacagaaagaaaaaaaagctcttgctaaaggttgtaaagttacccttcttcttcataacaagggcatgaataagccacatccacaaaagctgtaaactgagttggagcagctgatcggaaggcccctgtgagtgttgccacaccttcagtctgaactggaaatgtgtacagcttgcatcatctccactcagttatttgatatttcttgagtatgaatgaatgagtcagaaacattgcttttcagttgttagttttattaccatccattctttttacatacacgtgttcaaactgatattttcagtttattctcctttagcctttgaaaaattatgacagttttctgtgttctctcttgaggttttaaaaaatttactctaatagattgaaaagcacaataaaaacactagtaagagatcaggatttttaaatggtgatagagaatacttattatggagatggatttaggtattaggaaggaggaaactgattcctcaaacccatttaacaaactgggttaacacattatttctgtttcttagacttctcaataaaaggcatcttagccaattagcagcttttaaatgatgctctaggagcaactagctgtatttcctgtattggtattatatatgtttcttgcttgttgatggcattgaagcaggaaaattattgaattcttggccaaggctagggttggctgtaacacatgtaggatgcttgtaccaagtagggtaagagattccagatggcatttaatttgagtgattaaatctatggcatttacccttataagcacattaatctgcctgagatttgtacagatttcctttggaacctcattgctacaattgagggtaattttagtgaggtctcaaagctttggaggcaggcaaacctggaagttgaattatggttttgtttcttgctaatggagttacattagagaaatgacttcaattttttttagcttcagtttccttagcatacaatgggcaccataataactatcttgaaaagtcagtgtaagagttccaaagaatatatacaaaagagctagctaatatagtatctgacaatagtaggcactgtatctgttgttattgctattatttgggttttaggtcaaacttcattggttgcctacgtggctaaaatgtctttttaccattcggttgtaatttataccagacacttcaagtttgatggatttttataattcttagataactgtctatagcgcacatttctgtatcataaaaatgcttaaattatatttacagtttttgtggtataatacagacatgaacattctgaagttctaattagaagtttaggcttttcttaaattccagttacagaatgccagacagaagagctaactaagtacttttcctgttttactctaaaactgaaaatgcagaccttactaatttttagaacatgtgaaatgtaataagggttagtggtcaatgtgccttttcagtaaaacaccttttaagcagaatagtttcaccatgtttttggttacctttctctcatggaaagtatattgaggatgggagtcagtagagaggagagcaggacagcggcctgggcctcagggctttcaaggattatgctatggaaccctgtaacgttatcctcttgtgacctaataatgcacatttcaccaggccttccctgtaagttcagtgaggttcaaaggagaaaacgaaatcattttgagttattcccaagacatatcactataaaaatgtattttgtttctgctctaattttgggggcagtttgaggtttggcatggctggaaatgactgtgtttcaagctgaaagtctgtcttgaagttagaatccagaccctttctaagagacttcagatttttctatacttcattccaaatatacttaggccagctttacaaatgtggtcatgacttctttatggaatttattttgtgtatttggcttttggcaaacctctctagcatgtttctgttgcctataaattaaattgctttgctgggtgctttgtctcagagctttctctggctgctccccctactgctttgtaatagtcaatgcagaacatatagtaggactttttgttgatgtattttcttctgggcaagaggggtgttataacaaatataggatcttcatagaagtggctaaatcttaagatatttccacattatgcaactacagtgtaactcaacagatataaatgttaaacttttgctaagaaggaaactaagttaattggaaaaggcatgttagttttatagagagaaaacagcctcagttgttttctacattaacatattaaatcttagattaaaaaagtgttaatatgcctaaatacaaactttaaatttcaaaagaaaatatcttctataattatagaaaatcaacatttagatgttttgagttcgatatctgctttttcatctactcaataaaggtagatttgggaaagatttatgtagcttacatgtagtaccttaaagttaatatgaaagattgagaatcctataatcactgttagaaaaaatactttctttgcttttaagtaataatggaagagggaaacaattttaaaggaaatttttctttcactgaaaagtagagcccttgatgttaccttagcataaaacttaggattaaaacaaatcttaacttgtctctgttgtcatccgttcagttcctgtgccagtatttagtgaaagtttaattattcccaacatttaattatcaaaaactcctaatttttaattattcaataaattaatcattactagataaatttctttttttcagttacattttgacttaatatttggggtagtagtggtaacttctgtctgagagcattatgaactgtctacgttttcgaaaaaaattccgaaacataaggattgcccatgataaaagaagtattttttctaatgttatgggtagattaaacaaactggtatttttctagagagaaaggatgatagataatgcttttgttcagtttaagaagatttctgcgatagttacatagactgtagctatcacttaagatataaatacatgatggatgtgcagtgctgtttatgtcattattttcagtggattcacaaaatatgtagggtttggttttctctttttcagcaggagggaccaactctttttctagaactgtagattgctggggttaattttgtgatagcgtagctctagtaggggagcagtttttacatggctatttgttgtaatagtttaattgacactgttagtctgagatctttctagaatgtagagagatcagtagcactttattttaatattcacattagttttgaaaggcatttgaagaagactttttttattccctgtaacagggattggggggtatgccttgatatttgcttaaacaacaaacaattctgctgcgtccattaggaaattagttaagttcagtgaccaactacaatgacaataggtttattatcttttactcttagagaatagtttatcttttataaagtatttattattattatttagtattcagagcttcttgtttttgttttgttatactttgtatgtgataaggatgaatgatatttactccctggcctggagtaggcaccagtgatacttacagcagctttgtacagtgaaaagaacataaatgtttttcattaggcaaacttggtttcaaattccagctctgttgtttcctatctaatattttgggcaataggccttaccgctctggagctcagttttttcatttataagtggcgataatgaaaggggaaaataaaatgaaaaagttattgagaccattagctataatgtatgtaaagctccgtttggtgcattagcacacactgggtgctcaataaattgcatgtgcttgcctgtctagaatatactaaaaaagagagattaagaaaaactctgtgtcacatatttcttgcaatgtaaaaacataatatttcttagaagaaaaacatgacttttctattctttaagaatttacagtccaaattaatgttgctcaaactttgtcatttttgagacagagtctcgctctgtcgccaggctggagtacagtgatacgatctcagctcactgcaacctccgcctcccaagttcaagcaattctcctgcctcagcctcccgagtagctggactacaggcgcatgccaccatgcccagctaatttttgtattttgagtagagatggggtttcaccatgttggccaggatggtctcgatctcttgacctcgtgatcctccctcctcggcctcccacagtgctgggattttgtcatttctgtgtacattcatatctgctattatatgttgaatgttttaacttaatgtattttttattaatctttaaaatttatttgtcaattattcttaattgacaaatattaattgtatctatttcttgggtataatgtgatttttaaaatgtgtacatcatagaaagatttagtaaagctaattaacatatctatattacctcaccaatttatctttttgtgatgagaatgtcaaaaatctattttagaaattgtaaaacatataatacgttattaattactggggtctccatgcagtgcaatagatcactaaaacttattcctccaatctaactgaaattttgtactgtttgatcgacatcttccatttctctctccctcctcctctacagcctctggtaacccacctttctactctctgtttctgagatcgacttttctagattccccataaagtgagatcatttattaaagacaatatttgtctttctgtgcctgacttatctcacttagcataatgtcctgtagttccattccatgatgttgtgaatgacagaatttctttcttttataaggctgtgtaatcttttttttttttttttttttttttttttgaggtggagtctcgctttgtagcccaggctggagtgcagtggtgtgatctcggctcactgcaagctccgcctcccaggttcatgccattctcctgcctcagcctcctgagtagctgggactacaggcgcccgctaccacgccccactaattttttgtatttttaagtagagatggggttttactatgttagccaggatggtctcgatctcctgaccttgtgatcggcccgcctcggcctcccaaagtgctgggattacagatctgagccactgcgcccggcctgtataatctatatatatatatatatatatataatatatatatatatatatatatatatatatcacattttctttatgcacacttgatgaacacttagattgcttccatatcttggctgttgtaaataaagctgaaatgaatatgggagtgcaaatatctttttgatgtaccaatttcagttcctttgggtgtatacctagaagtaggattgttggattttatggtagttctatttttagatttttgaggaaccttcatactattttcaataatggtggttctaatttacattcccaccaacagtgtagaagggctcccttttctccacatccttgccaacacttgttatcattcatctgtttgaacatagccattgtacatggtggagagcaacacatactggggtctgttggcgggtgggatgggtgcagggagagcatcaggaagaatggctagtggatgctgggcttagtgcctaggtgatgggatgatacgtgaagcaaacatggcacatgtttacctatgtaacaaacctgcacatcctgcacatcctgcacatgtacccctgaacttaaaagttgaagagaaaaaaaaggaaaatagtcattctaacaggcatgaggtgatagctcattgtggttttaattgcatttccctgagaattagagatattgttgagttttcgtttgtttttgagacagggtcttgctcttttgttcaggctggagtgcagtggcgtgatcatgtctcactgtaacctcaaattctcgggctcaatgatcctgcctcagcctcccaagtagccaggactacaggtgtgtgccaccatacctggctttttattttttcgtatagagagggtcttgctattttgcccaggcttgtctagaattcctggcctcaagtgatctcctgcctcagcctcccaaagcactgggattacaggcatgagccactgtgcagggctggggaacattgttttttttttttttttttttttttgtatctctgttggccattcatatttcttttttgaggaaagtgtgtctattcagatcctttgtctaattttaatcgatttgttttcttactatttggttgtttgaattttttatatattttgaatattagcctcttatcagatgtatggtttgcagatattttctcctgatccatgggttgtcttttcactctattatttggttgcttgtgcaggtactttttagtttaatgtagtcctatttgtctatttttgttttagttgcctgtgcttttggagtcctatccaagaaatcattgcccagaccattgttgtggagattttcccttatattttcttctagtagctttacagtttcaggtcttatgtttaagcctttatatctcttttgagttgatttttatatggagtgtgagataagagtacagtttctttcttctgcaggtggacatccagttttcccaacactatttgaagagactgtcctctctccattgtgtgttcttggaccctttgtcaaaaatcaattgactgtaaatacttggatttacttctgggctttctatcctgttccattggttgatgtttgtttttatgtcaataacatgctgttttgattacagtagctttataatatattttgaaatgagggaatatgatgcctgcagctttgttctttttgttcaagattgctttggctattaggtctttttttggttcatataaattttaagatttttttctctatttctgtgaaaaaaaaagacattggaattttgaaaggaattgcattgaatcaatagaggaactgcattgaatctatagatggctttggatagtgtggacattttaacattactaattctttcagtgcatgaacatgggatatcttttcatttatttctgtcttcttcagttgtttaaatcaatgtcttgtagtttccagtgtatagatctttcaccttgttggttagatttgctcctaagtttttttttttttttttttttgtgatggagtctcgctctgttgcccaggctagagtgcagtggcgcgatctcggcttactgcaagctccacctcccaggttcacgccgttctcctgcctcagcctcccaattagctgggactacaggcgcctgccaccacacctgcctttttttttttttgtatttttaagtagagatggggtttcactgtgttagccaggatggtctcgatctcctgacctcatgatctgcccgcctcggcctcccaaagtgctgggattacaggagtgagccaccacgcctggctgctcctaagtatttttttgatgctattgcaaatgggattattttcttaatttcttttttggataatttattgtcaaagtatagaaatgctaagagcaacttattgttaaatctaaatactcacccaagtgcctcatcttaagtaatggtatacatgaaatcataggtttgatgttcaagttatattttttctgtattttttctaaaattaatgaataacaaaatgagaaaacattcatcttgcaccaccttaaagcattttgcctaccatttactaacactgggcatacttttggacacactagtctaaatcagctgcaagaacaatttagagactaatttattgttttaaacaatcaacatttttccttctttaccctcagttggatttctccactagaggagaaaatggcaaattcgttcagcagaaatattccaattcataaaatattcattccttaggcagaatggtccgtggatttagagcaccctactatagacagcctgcctgaattggattcattctctgccttttaccaaacgtaaattgggccacgttgccttctgtgcttcagttttctcatctgttaaatagttgctgtggtgatttaatgaattaaaagatgggaattgtctcgactgagtcaggaatcatactagatactcagtagaactcattcatttccatatgtgaaggaataacattagtttttattttattattttggggggtgagggttagagaagggtgtctgccatcctgatttctatccttttgataaagtgacctaataatattgatactaaccaaagaggactattataatgttttatttactcttctcccccattaatcactttttttggtggtgttttatatgttttattcctttattttcatccttcaaggagtttgccctttgtttccttctgtaattttacagtatagctcatcaagcaagcctgagatttttgtcagaatatctgaaaatctctgagctttttctagcagaaatgcataatgcagtgcagaagaatagtctagccagtgtttttcataaatgaatgtacatacgttcttcctctgcataagactgaaagtaacccaggcacacaatatcttattaatatttaatattaagaaaagtatattaagaaggtaactctccattctacctctcaacatcttaccatctagtatacacacaaatatttccttgctctatcagccgagagggtctagaagctaccataccccagtagcaatgagcacacttagcaccctcattttggtttctaataccattctctggtaaaaggaaccaagactctttgaaaaaaaatagctgatttctagggactcaggaaggaaatatgtaagatgagcctggagcatcttgtagtgccaaaaagtaaggacctgctcaaacaaatggaaccctacacccgtgggaatatactgaagagttgcaagagcaaactgaaagagctcccaatggccaaagctagaacaatttgagcaagaaaataatatagtattggattatatcccaaagggtaaaataaatatccataaacccatattgatacaatttattaaataaatacctaagtgggggaaaatagacaaatctcctcctgtgcggaattcccaataacttctatagatactctactctcaaggagggagaacataaccccctacaccgtaagtgtgagctgtgcatattgacttccttctaaacagtacagtgtagaaagggaaaaaaaagaaactgtagtggagaaacctatcactacttcagccaggttatcaaggtcaacattgacagtgataagtgataacatgtaccctcgatatgatctgatgaaaatggcacttttaatctgtggtttccctactgaaaacatataaccccagtgtaatcatgaggcaaataccagacagatctcagttgagggatattctaccctcgaaacttgaccagtatttgaccagtactcctcaaaactgtcaaggttatcaaaaacaaggaaaacctgagatacctacagccaagaagagcctcaggagacatgaggactaaatattatgtggtatcctggatgggatccagaacagaaaaaaggaaattacgtgaaaactaaggaaatctgaatgaagtgtggactttgtttaataataatgtatcagtattggttcaataattgtgacaaatgtgccatactaaagtcagacattaaaaatgggaaacagtgtagagtatataggaattatctgtaatgtctacacaagttttctgtaaatctagatctgttctaaaacaaaaagttttatttaaaagatcgaagccatcttttaaggcctatctggaatgttacatcctttataaagcctttttttttaatcccatcttcttcccatcctatatctggggtgtcctatgtctcccacctcaggctttcctaattggatacctttgactttccacagaacttttatttgtaattctcttaactcttagtacaatattttgtgtctctgttttattgttctgatgaggtcttctacggtgtttttagcccaacccagtgagtgtctggtgccttagaccacttggccatcctgacaccctacacagtgagtgtcaatataacattttgtagttagtcacataaattagtacaagaatgcatgatgttggttaatgcaaatgctgttttttaccttgtattggtagatggagagtctgagcattctactttgtgcctttcaagaaaggtttttttctttttctttcagtgacaggaatcctgagcatttctcacttaatctcagttctgcttttagatactcatgtctcagaaattttatcatagtatatgctagatcaatctcatctcgtttaaattaaaagtttgtagtgcacaggcaaaaaccatagaggccatattcatggtcataaactgctctttctcatctctacctattttagcaataacattcttcttattagtttgttccaagtgaaaatgacataactgaatactttccctgctagtctgggaagaaaggatgtgtttgttggcttttgcctgtcagagagtattctgcaatgtttgcctagggcatgcttgcattcccatcagcatctctggtctgctgcactgtaatccctatagggacagcctctggcttttattactgacaagcagtgcactgtgcagccataggcaccataataggaaacaccttggcctgtcataaacaggtctggagagtagaaagtacaggcctgctggggatgtgtccatagcaaagaggcaaagatgcggctgccatattggagtaagtgcaggctaatgtctgccatctccatttcagaaaataactggctgattttgaagctgctttttgtataaacagtagtgttttggttgctttttgtttttggcttaaatatgaataaagccatcttaaagagattatacccttcaaagtattttgagaagatctataaagtattttccttttgttattttacatttaattctacctgatcattccaatccaaacccaatagagaaggaaaaacagatatttcactatagtgggaaattaggaaaaaaagaaccatgcaaaaatacaagtgattgtgtgtcttttaaaagaattacaaatcacactgaattacccaaaattacaaagaaaagtgcatttattattaaggtaacttgtgttgtctgtgcctttacatcaactccaagttttataaaaggagtacattctttgaccataaagactttatatttgttagtgtttttttcaatctttagggaaaaaatgaactgcaatattaatgataggctttgtagcaagaatttaggaagacaataaatttcaaaattggaagggttatcacagtttttaataaagagataaaattatttcatgagtgctttaaatatatataggtgtcattttattatttacaaggaaacccatttcacaaaagaggctaaagactgtaaagattgaacaaagctataatcctgttaaaaattaagataggtttaggaaaactaaagtcctaattttttttttttgaccactttggccagagctgttcataaattaggtaatcaatatttgttgactagtcccctcccttgttaaaaactaaacacttgtcctcttgtatcttttttaaaaaaatatttcaagtaagtttcaacagtatgctgtgataaggatgaaacctattaacattatccttggtatatattttgattttctgttgttttcttaatcttatattgtcagtatggtttctaagatctaagatctccataagggtaagtgataattgggttttgataaatcataaggaatcttctactagaaatatgtctgtttatttattgtacatcaggaaacgattagtttactttatgccagaagataatgtttgggcctaaatcttaatttttctatctagtgttaatacagtagaatgcctaaaggatatatagaagaaaagacaaaaaaagaagatgaagagaatgcatcattacagactgaatcatcagtccctacagaaggggaatttgttctttcaaaagtagaatttcagcagccgggcgtggtgcctcaagcctgtaatcccagcactttgggaggcagaggagagcagatcacgcggtcaggagttagagactagctggccaacatggtgaaatcccgtctctcctaaaaatacaaaaattagccaggtgtgatggtgcatgtctgtaatctcagctactcgggaggctgagcaggagaatcacttgaacccaggaggcagaggttgcagtgagccaagatcgtgccactgcactccagcctgggtgacagagcaagactctgtctcaaaaaaaaaaaaaaaaaagtagaattcagctgggcatggtggctcacacctgtaatcccagcactttgggaggtcgatcacatgaggccagaagtttgagaccagcctggccaacatggcaaaacctggcctgtactaaaaatacaaaaattagccaggtgtggtggtgcatgtctgttatctcagctactcgggaggctgagcaggagaatcacttgaacccaggaggtagaggttgcagtgaatggagatggcgccactgcactccagtctgggcgactgagtgagactccatctcaaaaaaaaaaaaaaaaaaagtagaattcatgggaaaaattatttgttgctatttagccttatttttaaatatttcagtatattgtctgtttgatacatatgaacaatctgactacaactcattgggaaacaccagtatttaccttaccttctaatgtaaggcatgattccaggtattttctcatacctcaaaccttaaatctctaatttagtcccagaaacagtattctacatgtcaaaacgttttttgttttgttttgtttttggagacaagttctcaccttgtcaaccaggctggagtgcagtggcgccatcatggcttactgcagccttgatctccctggctcaagccatcctcccacctcagcctcctgagtggatggagccacaggcatgtgccaccagaccggcttttctgttttttaatttaatttaactttttttttttttttttgtagagacagggtctcactatgttacccaggctggtctcaaactcctgggctcaagtgatcctcctgccttggcctcccaaagtgcatgagccagtgcacccagcctcagaatatttttaaagatgaaaacctaatgctcagttaaacttttataagatctatgtgcttctaaataagtgtaaagatgactattttctggatgttgtattggtggggaagatggagagatagaagaacaagtgtttattctctggttgtattttctctctctctctcttttttttttttccttgagttagagtcttgcactgttgcctggactggagtgcaatggcgtgatctaggctcactgcaaccttctcctcccaggttcaagcaattctcctgcctcagcttcccaagcagctgggattacaggcgcctgccaccacgcctggctaattttttgtatttttagtagagacagggtttcactatgttggccaggctggtctcgaactcctgacctcgtaatctgcccaccttggcccgccaaagtgttgggattacaggcgtaagccactgtgcccgacctctggttgtattttcaaaatatatccaaataatattttaaaaatgtatttagtgagcactagattccaaaatagcaagagcaatttcagcaaagtataattcctagagaggaatcctacagtacctcgttttgccttttttgttctctaggtcatgtcaggatgggagcataactgacctggccctagttcctaggaggagcatgtgccctctaacatgtgcacagaaggataatagggtcagtgggatgaggagaccaagtgactaaagcagatctgagaatctgagctgtaaaggatttggaggtgggatggagggataaaaccttagtgggaagcagacagcagatagagaagatataggataaactcacggaaggtgtaagcaggttcatgattttaaaattagcctgttaagaggttgtgttggaggtctgttttcttagtgggggcaaagtggcaagggaagtttcacttctgaatagggtggaaaatgaagatataaggaaagaaagagagaaagaggaaagacgtattaggcagtgtgaggcagagaaagagaagagtgggagaaggaggggagtcagactttccttggctggaggcaaactgaccaatgcccgttgctgcccctttccaccgcagggttcatttggtgaaacctggttggactgaacctttaggagaaccttgaagtaaaaaagaaatcccagacaggtcagtggcggatgtaaatgtttaaggaagaacagacagtcagctgtagaaatggagggaggggtagagctgactggagagcgatttatggatggtatatttcatgaggcttgagtcttttttagcactaatagttggcgtcagcttcacctgttgcctccatgagtcatgccctggtagcagaggatggtgggccaactgccaagccatcccctgaaggaccggctgcctgggagtgaggaaaggtggttgatgggctctgagacagcaaggtacaaactgaaatggggtgaaaagagactgtcaaaataagtatgggctgatttgttctaatatatcataggttattattagatgctggaagagtaaaatggaatagaagatgaaaaatgtgaacctttatcttgattccattttaaatctcctaaattctgaggagctttgcaattcctcttctggatataaatctgccctacagtagagttgcaaccttggataaataaataaatttggcctccctgagcctctgttttccctgtaaatcaggactaacataatctacctcaaaggattgtgttgaaaattaagtgaaaacttacataaattatgtagtgtggtggggacatatgataggtactgtggcctatccttaggagggatgaggaatggaactatttttaaacataaaaggtcaactttatatgctgccatataagtaacccagtgcaattggagcttgaatcaacagggctgggagaaagcttacagagtgtgcctttgaaatcccaatacccagtcatggtgatttatgagaccttaccagcttgcatatgtgatggcccactgagtttgtttactttagttttagctcagttacccagcactctatgatagcctattttttatttacactctcactaactcctttattatgatttctttgaaagaatatgaagacagccataaaaaagactcttattgaagttgagagggtctcctgtaggtcttcacttcactgtgtctaaacattggtctgttgcttgtgctttgcttttctctcaccctggatgaccttcaaggctcttccaaatgatttctctgattccctgaaatactgaaattgtgattaacagaagtttcaagtgttaatcaatatcaagatagtagttgtctcttcctggggaaactagaaatgaaaaccaaacataggcctctgtaatcattgcacagattaaaaatgaaaatgcagctgagaaacagaggaatgaatgagaaaaccctaaacctagttctagccccaggatgaggtctttgtcatgagtctgacgctagccacagccggtaagagaaggaattccctagtagtgtagttgttacaagggaatgagtcattttgcaggtaattgttcttcttccattttccacttgctgtcagccactttacagaggagtcggactttgttctgcttaagagaagtctctttccttttattgtttaaaaaaaaaaaaaaattccagaagcccttagaaagagatttgtgagatcaactggtttaccttcttcattcagatgaagtaacaaagcacagaaaagttattttgtcaaggtttctgtcttgtagcaaatacaaactttctggtgttaaacatatgaccctgatttgggtctttactgacatcatcacttttttttttttaattttctgagacggagtcttgctctgttgcccaagctggagtgcagtagcacaatctcggctcactgccacctccacctcctggattcaagtgattctcctgcctcagcctcctgagtagtgggtataacaggtgcatgaccacgcccagctgttttttgtgtttttagtagagatggggtttcaccatgttggccaggctggtctcaaactcctggcctcaagtgatctgcccacctcagctttccaaagtgctgggattacaggtgtgagtcaccacacccggccaacatcatcacttttgaatgaaatttttagtttggtgatgactttattatttgtatttgatccttgtccatttttctctagatctggtactaatttcatgtggaaaataaatcgttaggaggttttcattttgtacgttttggctgcaaacaaccacaacccagtctttaggttttcactgagggatttttgttttagcccaattattgtatgacatgtatctgctccagaggttcttataggtgaaatgagatttttatgtatctgtattcaaacacatagatagatagatagatagatagatagatagatagatagatagcgaaacatatagacatacctctgaaaatacaaccagccatataatgtaagcctgttgtgtgttaatgaatgatagggtaataatacattatgttcctgtcctgtagaggagttcgagtattcaatacagaggaccagaatgattggtcccagaaaaagtgctccttaagctggatcttgaatactgaggatttatataggcatctaatagggaagaggtggtattccaggggctggataaggcagggtaggatggggtattcatgtggattcgctttattgtatgtttgctggagaggagggtagtgggcattctggaggagtgagcctctctggaacagaggatgtgattataggaccagtggcaggtgtgagaaatgtagattgaggccatactgcagactgtcttaaatgccaggtcaagccatttgcacattgtcctataattcatgaagaacccttacatttgactataaggaaaatattatgaagaaactaaaataaggtgactttagaaggttatatctggtggtagtgtgcaggatagattatatcaaggggaaattgtactgaaagcaagaagaaaccgttagggaattaggtgtaagagtgataagggcctgaaataggatagtgatgaaaagagaggaatgagtaggagaaagattgcacagagaagggtgacagcatacataagacttggcaggaccacagccagaagaaagcatgaaattctaaacctgaataatggacagaattatagttggaaaatcatgaagagaagccagttgggtattgggggagggctggacaatatgacagttaagtttttagacatataatttaggtaaggctatgtatctaagcggaaatgccctataagctttcagttgtcaggactggatttctggttaaaaaaaaaaaaaaaaagagggggcaggattttacttgggtgttgtctgcaaagttgatagctaagaccttaaggctcatctgtgaaacgggagtgacagtgctcattaaaggttattattagaaataaatgaagtaattccaggagagtacataggactctccttgacacatagtagaccctcaataaacattaggttttattattgtttattatgggttttagggaacaacacttttgtgaattattagaaccttatttgggaagctataaaagccatctgcgtgatgtgttttcttagtacaccaaatggaagttcatatgttccattcatatacatgcttccctagctgttaggggaaggtgatagcgcatgtttaactgttgatcactgtttgtaaggcttttcgtgttttttacatatttggttaaggatcttaatccttgagctgtattttgttctcatttgtttgtgtccagagtcaaattaagtttaaggaatttataaagagcttctttgcaagaatgatattaactcaatgtactaaagctacattcacccaaagtgtaatagacttacacaacatggaagaaatccaggagaggcagacagttattcatgaagagtggtagtattcctgtctgcctgtctgtacatttgtcagatcagtgcattctgagaaaattatgccaatttgaaatctccaaaagcattctcagccagtatccgtgattctgatagtttacaaactgttgatagcataagctgttaggaagatattgtagaaattttaatgcagctgttttaattagattgctttccttataacaagtttcagtgtttctggtcacaatacaatttattagctcctgacacatgacactgctggatcaccaaccttaactctgattctctccatacaacccagtatccttaagtaaaatgctgcatatttcattgctggtaagagaggcagggccaagattcgaactcacatgaagccaactagagaagcctatgctctacactattttacatctcataattctcatacactactaacctgttgcaaatgaaaaagaagtcttattattgtaccacttttaattgcacttattattgccttcagtaaagtcttcatttctaaaatgtcttagtaaaacagtaatttcataaaaatattgccaactaggagtactaaattctaattttggttatattatgcggccttggataaggaagtttcttaggctttcatattccaaattattggactattctaaaaacatttttaagtattttgatggatgtagtctattctaatataatgtctttcaagtgtttgaaagttactacttattcaaaactcaactgtctggcagcttttcttatcctgaactctgtgaagaacttcggggacaggaggtaaaatgtctttgaagagtaagaaatccaaaacttcatgtatttacatgttctggtcttgtctcataggattcttctttctccttacataccctcctttaaatccgtacctcccccggtcttctccatcttgcaaatggcaccaatgtccatcctagacattgatcatcccagaagtctaggagttgattcttctcatttcttcagttctgttgtgcaagtcttcaagtcttgtcagttttgcctcaagcacttttacaaactatcctctacagagacagctttacaaaatgtaaatcacatcctatcattccctgctcagaaccttctaatggtatcctcacaccctctggaaggctcataccctcaggacccacgtgatgttgccttgacttgcctcggctctcattccgtagacctgtcctccctcagactggctgtgttactcagcctttgttgagagtgctgtgccccaaatctggttggcttattctaggcattcgagtctcttcccaaataccaccttctcaagtgcagcttttccttactacttaattttatagtcccccatcaatgtacgatgttaccctcttttccttcattgagagtgtttgtaatttttttttgtctgcttgtttattgtctttttgccccataagtccaaggtttacatgaacagggaacttgtctgttttgtttattactgtatcccctatgctggcacatactatgtaataagtgtttgttgagtgcatgagtgaataaccattctaaaaaactctgatgtttaaagccctttgctttatataagaattttacttggaaccctggtattttcgtttgtatttgtttgttaataaatgtcaagagttcagtagtaagataggtttcagaaatgctaagttaaacagaataaagaaagaatatgtattacaggtcctggcagagccttgaatatgctaacatttgacagtgggagtctttgagaattatcacatgaagctgctgtacattacaacacattctaggaaatgctgtcttagacaaaaacctgtcatattagaattggggtaaggggcacgatactgaccgtgaggcagcagattcctatggactacattaaaaaaaaaaaaaaaaaaaaagaacagactgataatctagggctcagaaaaaaaaaaaaactgtgatatgaaacagtggcaaaaggattcaaaaagaatacagcggttgggactatctacttttttaatttttttattacactttaagttctagggtacatgtgcacaatgtgcaggtttgttacatatgtatacatgtgccatgttggtgtgctgcacccattaactcgtcatttacattaggtatatctcctaatgctatccctcccactcccctcaccccacaacaggccccagtgtgtgatgttcccccatcctgtgtccaagtgttctcattgttcaattcccacctatgagtgagaacatgcggtgtttggttttctgtccttgcaacagtttgctcagaatgatggcttccagtttcatccatgtccctacaaaggacatgatgaactcatccttttttatggctgcatagtattccatggtgtgtatgtgccacattttcttaatccagtctatcattggtggacatttgggttggttccaagtctttgctatcctgaatagtgctgcagtaaacatacatgtgaatgtgtctttatagcagcatgatttataatcctttggatatatatccagtaatgggatggctgggtcaaatggtatttctagttctagacctttgaggaattgccacactgtcttccacaatggttgaactactttacagtcccaccaacagtgtaaaagtgttcctatttcttcacatcctctccagcacctgttgtttcctgactttttaatgattgccattctaactggtgtgagatggtatctcattgtggttttgatttgcatttctctgatggccagtcatgatgagcattttttcacgtgtctgttggctgcataaatgtcttcttttgagaagtgtctgttcatatacttcacccactttttgatggggttgtttgattttttcttgtaaatttgtttaagttctttgtagattctggatattagccctttgtcagatggatagatagcaaaaattttctcccattctgtaggttgcctgttcactctgatggtagtttcttttgctgtgcagaagctctttagtttaattagatcccatttgtcaattttggctcttgttgccattgcttttggtgtttcagacatgaagtccttgcccatgcctatgtcctgaatggtattgcttaggttttcttctagggtttttatggttttaggactaacatgtaagtctttaatccgtcttgaattaatttttgtataaagtgtaaggaagggatccagtttcagctttctacatatggctagccagttttcccagcaccatttattaaatagggaatcctttccccatttcttgtttttgtcaggtttgtcaaagatcagatggttgtagacatgtggtattatttctgagggctctattctgttccattggcctatatctctgttcttgtaccagtaccatgctattttggttactgtagccttgtagtatagtttgaagtcaggtagcatgatgcctccagctttgttctttttgcttaggattgtcttggcaatgcgggctcttttttggttccatatgaactttaaagtagtttttccaattctgtgaagaaagtcattggtagattgatggggatggcattgaatctataaattaccttgggcagtatggccattttcatgatattgattcttcctatctataagctttgtgtcctcttttattttgttgagcagtggtttgtaattctccctgaaaaggtccttcacatcccttgtaagttggattccttggtattttattctctttgaagtaattgtgaatgggtgttcactcatgatttggctgtttgtctgttattggtgtataggaatgcttgtgatttttgcacattggttttgtatcttgagactttgctgaagttgtttatcagcttaaggagattttgggctgagatgatggggttttctaaatatataatcatgtcatctgcaaacagggacaatttgacttcctcttttcctaattgaataccctttgtttctttctcctgcctgattgccctggccagaactttcaacactatgttgaataggagcggtgagagaaggcatccctgtcttgtgccagtgttcaaagggaatgcttccagtttttgcccattcagtatgatattggctgtgggtttgtcataaatagctcttactattttgagatacatcccatcaataccgaatttattgagagtttttagcatgaagtcctgttgaattttgtcaaaggccttttctgcatctattgagataatcatgtggtttttgtctttggttctgtttatatgatggattacgtttattgatttgcatatgttgaagcagccttgcatcccagggatgaagcccacttgattagggtggacaagctttttgatgtgctgctggatttggtttgccagtattttattaaggatttttgcatcgatgttcatcatggatgttggtctaaaattctcttttttttgttgtgtctccgccaggcattggtatcaggatgatgctggcctcatcaaatgagttagggaggattccctctttttctattgattggaatagtttcagaaggaatgttaccaactcctctttgtacctctggtagaattcagctgtgaatctgtctggtcctggactttttttggttggtaggctcttaattattgccttaatttcagaacctgttattggtctattcagggattcaacttcttcctgatttagtcttgggagggtgcatgtgtccaggaatttatccatttcttctagattttctagtttatttgtgtagaggtgttattctctgatggtagtttgtatctctgggggattggtggtggtatcccctttatcattttttattgcatctatttgattcttctctcatttcttctttattagtcttgctagtggtctatcaattttgttgatcttttcaaaaaaccagctcctggactcattgatttttttgaaggtttttttgtgtctctatctccttcagttctgctctgatcttagttatttcttgccttctgctagcttttgaatgtatttgctcttgcttttctagttcgtttaattgtgatgttagggtgtcaattttagatctttcctgctttctcttgtgggcacttagtgctataaatttccctctacacactgctttaaatgtgtcacagagattctagtatgttgtgtctttgttctcattggtttcaaagaacatctttatttctgccttcatcgcattatgtacccagtagtcattcaggagcaggttgttcagtttccatgtagttgagtggttttgaatgagtttcttaatcccaacttctactttgcactgtggtctgagagaaaatttgttataatttctgttctattacatttgctgaggagtgctttacttccaactatgtggtcagttttggaataactgtgatgtggtgctgagaagaatgtatgttctgttgatttggggtggagagttctgtagatgtctattaggtccgcttgttgcagagctgagttcaattcctggatatccttgttaattttctgtctcgttgatctgtctaatgttgacagtggggtgttaaagtctcccattattattgtgtagaagtctaagtctcttagtaggtctctaaggacttgctttatgaatctgggtgctcctgtattgggtgcatatatatttaggatagttagctcttcttgttgaattgatccctttaccattttgtaatggccttctttgtctcttctgatctttgttggtttaaagtctgttttatcagagactaggattgcaacccctgcttttttttgttttctatttgcttggtagatcttcctccatccctttattttgagcctatgtgtctctctgcatgtgagatgggtctcctgaatacagcgcactgatgggtcttgactctttatccaatttgctagtctgtgttttttaattggaacatttagcccatttacatataaggttaatattgttatgtgggaatttgatcctgtctttatgatgttagctggttattttgcccattagttgatgcagtttcttcctagccttgatggtctttacaatttggcatgtttttgcagtagctggtactggttgttcctttccatgtttagtgcttccttcaggagctcttgtaaggcaggcctggtggtgacaaaatctcagcatttgcttgtctgtaaaggattttatttctccttcacctgtgaagcttagtttggctgggtatgaaattctgagttgaaaattctttcctttaagaatgttgaatattggcccccactctcttctggcttatagagtttctgctgagagatcagctgtaagtctgatgggcttccctttgtgggtaacccgacctttctctctggctgcccttaacattttttccttcatttcaactttggtgaatctgacaattatgtgtcttggagttgctcttcttgaggagtatcttcgtggcattctctgtatttctggaatttgaatgttggcctgccttgctaggttggggaatttctcctggataatatcctgcagagtgttttccaacttggttccattctcccatcactttcaggtacaccaatcagatgtagatttggtcttttcacatagtcccatatttcttggaggctttgttcatttatttttactcttttttctctaaacttctcttcttgcttcatttcattcatttcattcatttcatcttcaatcactgataccctttcttccagttgatggaattggctactgaaacttgtgaatgcatcatgtagttctcatgccatggttttcagctccatcaggtcatttaaggtcttctctatgctggttattctagttagccatttgtctaatcttttttcaaggtttttagcttctttgcgatgggtttgaacatcctcctttagctcggaaaagtttattacccatcgtctgaagccttcttctctcagcttgtcaaagtcattctctgtccagctttgttccgttgctggtgaggagctgcattcctttggaggagaagaggagctctgatttttagaactttcagcttttctgctctggtttctccccatctttgtggttttatctacctttggtctttgatgatggtgacgtacatatggggttttggtgtggatgccctttctgtttgttagttttccttctaacagtcaggaccctcagctgtgggtctgttcgagtttgctggaggtccactccagaccctgtttgcctgggtatcaccagcagaggctgccgaaccgcaaatattgcagaacggcaaatgtagctacctgatccttcctctggaagcttcatctcagaggggcatctggctgtatgaggtgtcagttggcccctactgggaggtgcctcccagttaggctactcgggggtcagggacccgcttgaggaagcagtgtgtccattctcagatctcaaacttcatgctgggagatccactactcttttcaaagctcagttggaaatgcagaaatcacccgtcttctgcatcactcatgctgggagcagtagactggagctgttcctatttggccatcttggaacctcccccagctatacctactttattggatttttgtgtctccatcagctgacatggtacttacagcctagaatgagcatacaaaggatactcattcgctattcgatgatgactgacaaacagtctcccaggatcaccatgaaataactaaactgagtttgatttatttaaaaatcaggtccaggtaacaaactgcacctgtccccttgaattgatacaaataaaaataaaacaaaaaaggacaatattttactttatggaactttttattacaaagaattaaaaaaaaataaaataataatacttaaaagaatactttgactattattttatcacctaaaggcttctcttattattttatttttggagacagaatctctgtcaccccggctggagtgcagtggcgcgatctcagctcactgcaacttctgcctcccgggctcaagcaattctcctgcctcagcctcccgagtagctgggattacatgagtgcaccaccacaccctgctaattttttgtatttttagtagagacagggtttcaccatattgccgaggctgatctcaaactcctgagctcaggcaatctgcctgcctcggcctcctaaagtgctaggattacaggcatgagccacagcgccctgccaacctaaaggcttttcacaactgggaattcactgaatgttgtatcattaaagctaatgtggaccttggataactgtatgcctgttttctgggaaataatggtggagctctttgaaagggtaaaaatggtgttttatcatacataactatgcctgaggtttttgttttgcatttatctttgggcaaagttgtaaagttaagcaaatctggaattgaaataatttgataacatcagctaatatttttcaaagttagatttttgaggtataatttacataagagttactctttctagaggtatagttgaatgcattttcacaaatgtgtacaattggataaccaccaccataatctagatatataggtaatgtgtaattataatatatatgtactatataatataggatatttataccacccaaaaagttttctcttgctttttatagtcattccccaaaccccacgtccagtgctgattgtccctatggttttgccttgccagaatgaataatacattaaagatatagccttttgtgaatggcttctttcacttacaatacttttgagttttgagttgaattataagtttcacttataatacattttgtgttattgcatctattggtaatttgtttcattttattgctttttagtatttcatttttttccagtatgtcattttatggacacaatttgtttacccattcaccagttgactgatatctgaactgtttctgggtttctgctatagagagttgctataaacattttcatataggtctttatatagacatatgttttcatttctcatgggtagatacttagaagtaggattgctgggtcatatggtcactctactttttaactttataagaaactgtcaaacctttttccaaagtttctataccattttgcattctcactagcaatgtatgagaatttaatttgctctgcatccaggccagcattttgtattgtttgtattttgtattttatacattctagtaagtatgtagtgtggcatctcactgtggttttactttttgtttccctaatgtctaatgatggtcatggatcttttcacatgcttattgatctttttgattcttatgaagtgtttgtttgttcaaatcttttgaccatcttttcactggattgtcctcttattgtgttgtaaagattttttaaaaaataatttctggatacaagtcctttatttgatatgcattttgtacatattcccttctcaagtctgtggcttgttgttctgttttcttaacagtttttttcaaagagaaatttggtaaagtccagtataccattttttattttatgcttcatgcttttgtggtttaagaaatctttgcctaacgcaagatcacaactactttctactgtgttttcttctagaagttctttagttttagattttacatttagttctatgattcatttcaagtagatgttagtgtggtgcaggataaaggttgaagtttcttgttttatgagtggatgctcaattgttcaagcattctttgttgaaaagaatatcatttctcttttatagctcaaattttattacttaaaattattttaagatgcacatattaaagtgatatgtgtaaaagattatatatttctggaagcatgcctatttacactagttattattactttaggagacagatattctctttgtttaaattgtttccacaaagcataccacgaagtacagaggggacattagtaactattttatgatgattatggtattcatttaggccaatttaagtgaattggagatcctaattttctctataaggagacaatactttttcatacaagattatttttgtggaggcttcatttatgtgaagtttttgcacccatttattgtcatgattattcttcagtgaaacaaaagtctgtagtagatatgctgctgctgctggttttaggtaaattgactaaatagttatacaaaactctgtctctaccatatatgaattcaaactgtatcaacaattacagaatactatgctaacatctaataagagagttagcccatgtagaagagaaatataaatacagctatcagatcagtctcatgttatttcagcttcaaggagcctcttagcaaaaatggtttcctttctccatacatgttgcaggtgtttactattttaaatgagacttttttgttaaaaaaaaattaaaataagatcatttagagaacgattctcagcttgttcagatgattatttggttttaaaaaagcagcctggagttcctcttaatctcaaatctccataaaacttacaagagatgttttcatttactgaaaggaatagttttttcttaatcaaatgtagagccattatcactagagggcagtaaatacaaacagatttagtggatttactggcactaacgatgttttcagaatactagcattaatcaaagaaagtatagtttttataatatgaaaatacatgtaacattctgttatgtaaaatattggttatgaatcaattctagattattgtctgcctctaaaatatttttaaggcatttgaaagcaaagggaggctgagaaacactagttttctgtggctattctgtttaatacttgaagtttaactttgcctcagaattcttcaagggacatttaaaaattagatttgcatttgttcaagctgaacagtactggatatatgagagaccacgttatatagatttgcttcttgattaataactaccacgacttttaattttaaggtgaaaggtgtaaaataaatgtagattgattataggataaaatattttccaataatgtaagtcctactgcaaacagtgctactgcctggaaaactccttatgttggagaggtccaagagctaatacacttattttaaacaatatttcttaaatatttcaaacacagtaatataatatacagcttagaattgattatattaacggatctattatgtaggctctaggctaaatataaaataatgcctgaaatagttttctttttttggcaatttagagtactctgaaaccagacagtctgggttcaaatcctggccctgttacttactactggctttgtgaccttgagcaagacaacttgacctctctgagccttagtttccccataatttagttttgtttttccctattcaaaaatgcatcttttctctcttgacctctgttacaaagtcaataatgacagcatgtgttaatgtatcagcagttcagctccatcagcagaatttcaaatatcctgaaatgtactgaaatagttcaaaaagattgttaattgcttgggtatctggtaaggactgagaaaacaaggaatagcagggaagtggcctctagaaattctgaggggtatttctaggaaaagtctgaaaaagagaactaactgaacattatgggaattttttttttcttttttgagacaaggtcttgctctgtcatccaggctggagtacagtggtgcaatcatagctcactgcagccttaaactcctggcctcaagccatcctcccacctcagcacctcccacctcccacctcagtagtatctggaactacaagcacatgccaccacacctggctaatttttaaattttttgtagagacggtggtttctctatgttgcccaggctggtctcgacctcctggcctcaagcaatcctcccgcattggcctcccaaaatgttgggattacaggcatgaggcacttcaccaggccaagaaactattttttctatttcaacaaacacacttgcatatatgtatataaaatcatttgggcatttgagagcagtggattacagataagaaacctgagctctagctgtaacgctgtccctcaagttgtgttgtcagaacttttctggacctcagttccttgtctgaatgtgtcgtcatcattacatctgcatatgagggcagctgtgtgttgttcacatagcgctcccaaacataagcgtgtctcactatatggcagggctgtctgcctgtgggcacctgcttcctcaccctgtccagagatctgaccatggtgatagtaaccatgattctttaattcaaggcactgtaaagttagcaaaaagattgaggataaacaaatccactcctagattcatactgtttatcatagagtttgcatcagcctaattatatgatgagctgtcatacaccattaagagcaaggactgggtttgcatttcaatcctgtcacctatggagcaagttattgaatatgtaagaaggtccatcttttcatgttaaaatagggataatatttatcttatcagaatgttgccaagattagaaatgaggtatgtaaagttctttgtgcatagtaggtgcctagtaaatgttgtaacttattaaagtttcttcattaaatttggtgaagccaagtctgactataagaattgtatctctctggctctattcaaatttctcttctaaattatctagattctctctgcagatagcagctaccgtggcaataggaaggagattctagtctcctagaaatggagattagggaaaatgaaatgaattttaatttggctcagagatttttgaaaagatttcttattccctagaaatatggaaactttccttggtactttttactcaatatgattaaataatctcccttattgcagcaaattagggacttatttgaataagttaaatcctttcacatccagcacctattagaatgcctggcacataatagttgccaaatagaagtctgttgaatgaagggaccatcactcacattcagcagggagaagaggctgcagattttagagggaagggaaactgtatgtgtgtttctgcataatgttttaagacaaggagtattatctactatatgtaatctgttttaaatgtttttgatgattttgctgagggtgaaaacccttgtcctttcctgtcacctataatcagtataaaaatattgatgttttgcatctgcatcagccaacaatctttttgtggcaatagtacactaccttgagaaatacagggacataataagatacttttctggcctcaaagatcctccaccctggatgaggagtcaaagttgaagacagttgaaaaaaatagaacagtgattcttaacactggggaacattcaggaaatttcaggggacagtgactggggagtactcctggtgcttggtgggcagaggccagggaggctagatgtcctgggatacatgggacagcctttcaccagggaggtttgctgtgtgtcccacacaacttccaaaaagtcccagcagctattcacataggtgaaaaaacaaaatgcatttataattctctgagcctagaacccaactactttttacgtataagtattaaatatttttacatggttttaatccacaccaaattttctagtaatgcagcaatagtgtatattgtgaagatggcactttgttacatttgaaacctttcaaagaatcattcatcatatcaggaaaaaggaaaatttttctaacataacacccctgtattcattttcatgctactgttacttttgtggtaattctccccataagagaaatcatagcaaacccttagatagcacttactgttctaagagccttatgtatatgcactaatttaatcctcacaacaaccctgtaaggtagaaactattattctcattttccatgtgagtaaactgaagtatgggaaatttaaatagcttccccaaggtcacacagctaatcagttatagtagtttttgactactttttaaaatgtagttgtgtacaagtatttatattttgtagtatttgatagaaattactcatttctcctttatttcactgataagccattatactgattttttttttaaatctatgtagggagtatttagcctatatgtattcagtacagtattatgaaggaagtgtatttaggaatttcatttcaggatgaatacttgttataaaaagtaaaaagtaactgagtcttaagtttgtcaaagaataaaattgatggatggatggatttttttttttttaaaggagggggaaggcagtgagcctgactgcagagtgtaatttgcatttaaatgacaagtggtatgacacttccacctgttcttcagggagcctcaccaagtatgttttgcctcgaggcctttgcttttgccattcctcacttggttttcccttctctaccctacctctcaccccgcaatccacatggcttgtttcctttcttcagatctcctggtatacgtcatctcatcagaggggctttccatgatcaccttatagcaacctctatccgtaatccttatcccttctttctctccattgtgcttatcaccccatgacgtattatgtatttattaacttagttttggaatataagctgcaggtgagaaagctttgtttctctttctcaggcagtgcctgacatagagtaggagcttaataaatattgaatgaaggggcagatgtagaatcgttagaatttggaaaaaggctggaatatttggtcctaagatgtactttgaatgatttaaatctgactgagaaaaccagtttgaggttggcagagtagaagaaggagggtattttaggccgagaatttggtaagacagagatgggattgtcagctgtatggtgaaggtggaggagtactagtctttcaggaacagagcaaatgtaatagagcagctgaaaataggcttggcgttggggattaaggtcagatatggcagtctggaatttacagagggatgtgatgaagcaggcattactagctttgaagtaacaggctgcggctggatttgaggaaaattgatctggcagtagaggtcaatatgagactagaaggggaaaagccaggggcaagaagatgagctaagaagcaattacagcattttggccctgagacatggagtgctgtgatgcaattgaaaggaaatataacatatatattttaaaaacaaatgacaaaccagagaatttttttaaatattagtataatagaatgattatcataatgatcattgtcactgtcatctttactgtctgatacctacttatcttcaactttgtaccatttgttgttttaagtgctttgcatatatggtctcatttaatcctcatatgtatctgttctggttatttattgctatgtaagaaatcacttcaaacctaatactttgaaatatgaatgtatttttattagttttcatggctttgtgggttaactggtcttggctagacattcttgcttggcattcctcatatggttgcagcccagtgggtagctatctgaaagctgaactggctggatggctaggatggcttcttgcccctcaggtctggctctgggctggggtggctggcattgctgaagactggccaggcatgtgtgctctttcttgtgcaagtgctctcttgcgctttctctcttcactgtctgtgaagttaacatggacttcttgtagcatagcctctcagagtagtcagacctttttttttttcaacctaatggcttaggggtcccaatagcacattcaaagaaagcaggatgagagctgcaagatttcttatgacttagcctcagcagtcatgcaccatcacttgttggttacacaagccaactcagattcagtgtaggacagtgtggctcattaagagtatctttggagactagctgccacagtaatccactttacagatgaggaagctgacacactaaaaagattatttgtcagtgattgtgcacaaaagatttaaacttgcaattcttgttctcagtaccagagtgaacctgggaaaatcattttttctctctaggtctcaactttatgtggaaatgagggagttagagggggtgatattaaagttactttctatttctctcagtcttttaaatatttggattcagattacgggaggggtaatggtaaggaataaactgaaagaaacagctctggataaaagatagggcttgctaacaaagttgaatgaaggagggaaggtgatgccgtataggggaacatgccgggttactcaaggattcagctagatggtttatattaaacacctgacagtgtctgacgcacatgaaacacctgttgaatggtaggaaagagtcatagattccatctgagatactggaagaaatataggctcactgactgaaatggaagtaattatactaagaactactttaaatagaaaaatgtctcacagttttgaaaaagtttgtcgtgactagcagggcattcgagaggagaatcttgtattcagaaatatggcactgaagttcaagttagaagtggtcattgaagattgtgggcctagggaaaattaaagaagttcaggatcctgggagttgagggagagtagtaggaatgatcaaacatgtggaacacttcagagaagtagggagaccagagaaaaggaggaccttagtattcctctgggggtagctttagtggaatgttggagctttaatttcttccttttgtagaggagtaagagtgatggaaatgaatacaacagatgttaacaaaagcagaggactgtagcagctaaaggccaatagaaactcagagagacacagtgttacaggagtgcttatcagagagcatgctctctaagacagacatgccacatgtggaaatagttaaatgtcaggaagactgcagagtagccataccagcaagttaaagcacagagtagtaagcacaggctttgagatggagaggaggtaaaatgcacagaattatatgctaaaatcaactaaaacctagtttttccttgtttctcacccacaagacctctttagtattaaagttacagggtaatactacaccaaaccaaatagaaaatgctgtttttctagaaagaactttgatttctcatttaaccctcctcgtaaaatgtctgattactcttgagctcaattctggattcctaagagccactcattcctttcttaactttgtgtacagttattaaaatgttctgttctggctgggcacgttggctcacacctgtaatcccagcactttgggaggctgaggtgggcagatcccctgaggtcaggagtttgagaccagcctggccaacatggtgaaatcccgtctctgctaaaaatacaaaaattagccaggcgtggtggtgggcgcctgtaatcccagcttctcgggaggctgaggcaggagaatcgcttgaacccgggaggcagaggtgacagtgagccaagatcgcactactgcactctagcctgggcgacagcgagactctgtctctaaataaataaataaaatattctcttctgatcaaaatacagatcctgagttctatatacaaaacactgcattccttatgcatacacagtgccctagctttcacatttccctccccccagaattgcaagtggtcccacccctagattttgaaggttttagaactctgtcatacataacaatagaaacaaaaggagctgagagcagccatggcacacaggtgagggaatgtgtcattgccatctgtgccatctgtgaattctggacattagtcgtattgtttaatccctatgcttttatgttggatgaggggagaactacagtcatttctacatcaccagggagccacttgttttggatttgagagagggaagcaattaaaatgctcgattgccatttttggagcagtttttatttggaaggaagggaagccagaggacattaaaattcatagaaaatgccctccaaaaggatgggcaattcttaagaatgaactacgaattttgaggagttttatggtcattattcatcactgcaagagggaagccccgttcatcttttctcagggtggcctcagagctgcagggataccattattcaatggcgtttgtcgggtgaggagaaagcctccccagaggctggcccttgccaaccaatcccaaagcagcctgcaccgaggccacaccccctcgccttataggctaagagctggaatgcaattggtgcagagttggggttttatgggaggggcttcttgtcactcttcccggcttccctgcagttccttatttggtagcttttgacaggactagcctttcttgcaactaagcatcttgacatacattattcattaagccctggagctcgggagagaaagatgcagacccttagatctttagatattcctttatcacgtggattttctttattcagaatagttgctgaattttgtgccattctggagtcttacaaatggcatgtattcgatgggaagacggctggatgggatttaatgcgaggctttcttatgtatacttaattaccaaaaatctttaaaaactcatactctgcgtggcttgtggaggttgttaaagtgtcgagattttgaagctaaatacattttagagcttactatatatatacatatatatatatatacatataatcaatcaaaaatgcctgaagcaaactatttactgtcagtgtcttggggctacataaaggtaagacttacttagcttttgaaaactccttactctgattacaaaattatttagaaagcttagactctactgtaatttgttcaaactatcagttatgtattctttccttacacatgaactaggaagaaatacgtgttaatagtggtcaagataagattgtataactttcatcagttgtagtttgagtgttaaaatagcttttttagatacgcagtagttcttctgtttgtcatgtggtatatgtttgaattgtgcttgaaaaatatatggtaattaaatacattcattgcaaataaattattgggccaaattacttatactgatttatggattccagttagtatgttgcacataaagtttataaaattaatttgtggctgtttctaaaaatctatactactttaacctgacgaggaatacgtttttttcacctttagctataaagccctaggtgacattaaaaattgacattacttaactatgtaagtgatactaaagtgaaaacttgattgtctattatacttgcaaaactgaacaaagtttttattacactgttttgtgaatctcaagaaatgaattaataaacaattcaataagattgtgtccatgcttggcaggctttttccatgccctgtggtaacattagcattgtgatcctgtctccacaatagaaggaggtagaaaaaccttattcagtcctaaatgaaacatcacttcacagatttttggtatttgagccactcgcttgaacctgggagccaatcacaacacattttaaaagattcattttctgttactctgaggatttttcagattggagtgtttgtcgtttgctttgtttctttctttttgaaggacaagttcccctttgttttagagatttacttgaattctaaaaaaattagaaaacttatttcagtcttggttgtccaagtagtcatgattccttacctccctttaaatctgtggatgattcagatttttaaaaatgtttttaaaatatatagacttccattatttgaattttgttagccatttcttggctaaaaatcttcagaaatgcagaaaagtatagagagtaaatataagaagccctcattatccgccagaattcagctcctagcttttagccagctcacaactgatgttatttttgaagggcttcacatttgtactgtgattatgaaccatttgtactatgattatgaacaatattgccaagaatctacatatagaattttagtacgtttctttttgaggaaaatttttcctggacagctttatgtttaatactgtacctttaaaaacatgtaaaaatagcaaatatagatatatttggtcttatgcattttgaaggttttatttttataccatcaatggagtatttgtttaaataactttgaatactgatatctaccaaacttgtaatgcatcacagtgcagcatattcaaatgatttttagcagaatattgtcaggaaaaaataagaaaattttcttactattggacccataccacctccttaaatatatattgggaggatatataatatacccagtagcacactggcgtgatgtagaagtaaaggagattacatttaaggacattttgttttattattttagtttgcttcctgaacaatcttaaatgcctaatgtaaattgaagaattgcagttctgaaaagcaaaatacagtattgagattcaactgcatttttactttcctttatgccttaactgctgtacacagacattctgatgtataatgagaacaaaggattcaaaagcattcacttagaaatcctcccgtttttttagttgcaaccctaaatctgtgtattgttttcagactacttaggccaaaaacaattagaaattcatcaatggaaaatatttagaggtcacttaaaaaaataaactaaatgcttaaatggttctgcattttacaatcggttcgtttcaaacagcagtttaatgttttgtcccttctaaatatattaattgagaaatatgatgggatttcccagaagaatacattgtattagctttaaatcagtccttccccctttggtaattttatgtagttatcttagtaaatattatataattatttttagatgagagaagtatcacatttttaaatgtttgttgaatgatctagtgcatttttttagtacatctagctatgcactccaaaaccaatttgtgagatcaactaccagttgagaaagcacttatggtaatttttgtggttattcatttagctttgctggactgaaacttttatatggatagcaaaaaaggaaaacaatgttaattccttttagaaaatacccttgtgttataacttaatgtacgcttcagaattatctttaggaaattccttagaccgtcttcctagagtagagaagtaattgcttcaaatattgtcttttataattatgttaaaatgaaatgttgacttccttggagtcccttataagccttggtagggaggtgggcatgtgatggaggatttctccaatccatgtttttgtgttttaaacaaaggctggaaagtactctgggaataatgtatatgaccagaaagatgaacatgcaggatgtcacttatctagtctgtacaatatttagattcctttcactggcttttttcttcagttatctgtactaactggctattttggtgaattgtttaagcaaactgccaggaaaattatacttcgttctttatattcttttagaaaaatccaataatatatgtagcatatctgcaggtagcatccacatgttctctttgggcaacataatccttatactagtttgtgtacaagttagaagataaacctgtgataactgggtctctatctatctttatcaatcactcccagaaggcttcccttgttttgctttattgagagaagtgcaaggagggcagcagttcctgtatagactgctgagattctagcaatggtgaaagctttgcctcatctcctatcttttatgaaaaaaaagactttgtcatgaccaggtagttcttaatagcaacttttagctcataacatgaacaattttaggtcaaagagatatttcattgaatgtgtgtttaaaatgtttagcagactcttttctttggaatatgctttgcctaatgagtatatttttccaagtgtgaatttatctgtaaagcaaattttttttaattattatactttaagttctggtatacatgtgcagaacgtgcaggtttgttacataggtatatacatgccatggtcgtttgctgcacccatcaacctgtcatctacattaggtattttgcctaatgctgtccttcccctccctacccgctcataggccctggtgtgtgatgttcccctccctgtgtccatgtgttctcattgttcaactcccacttatgagtgagaacatgtggtgtttggttttctgttgctgtgttagtttgctgagaatgatggtttccagcttcatccatgtccctgcaaaggacgtgaactcatccctttttatggctacgtagtattccatggtatatatgtgccacattttcttaatccagtctatcactgatggacatttgggttggctccaagtcttaagcaaagagttttttaaacctgtgtatgcatgacattttagctgtgcttttgagacatagctatggtttcccatactaatgctattccaaattctttatgggatttgagaaagaggagctagctatttaagtaactatttttatggttataactacagtcaaatccttcatctgtctgacctgcaatgataaaaatcagctattactttaaaaggcccaaaagttatggaccaagtgccagaaagtgagctgggagaaagaactcaaataatattgagcatctactatgtgccaggctaaatagaagacacttctatattagctcattaaattatatgatagcccataatttactcaagaaaatataactttgtaaagagggacagaaaaaattttgaactctattataaatgtctacaaatattcttagaaggcccaaagtttatttttttcagtaggttataagatataatgctgagtgaacacaagcagtaacctatgttctgtataccacctgatgccagttttaaaaatatgtattcacatacaagggtagaaaaaaggcataaaaggaaatttaacaaattatctgtggttatcttccagcagtggggatttacattattttcttttttttggtatagctttctacattttctatagcacatgtacattttataattagaaaggagttataaaaacatatgaacaaagaagtgaatttagtgttcctgagtttgagactaagctttctagaccagtaatttaacaaccagaatttgtactggtcatgccagttctttgtttttttgtttgtttgtttgttttttccccagcatttattttatttttattatactttaagttctagggtacatgtgggaattgaacaatgagaacacttgggcacaggaaggggaacatcacacattggggcttgttgtggggtggggggaggggggagggaaagcattaggagatacacccaatgtaaatgacgagttctttgtttttgactacgctggcatgcgaatacacatttctctcatccaacagtccattgaaatggttgagggttttttgtttgttttgataacagttaaatgcggagttaaaacttaatctagatggtctataagattgactttggaagttatttagcaaacggtatagagttaggccatcttggtatgaattatgcagagaagcaaaataattctaaataattaaatactaagaattatatttcaaacatcactaaaatatacattcaacacttaccttcatacttaaatgagaatttatggtgaaatttcaaattttaaaggctaatctgatgattagagtaaatgcatctgacttttttttgtcaagtatctaatagcagttactctatgtgtagaaaaaatacattgtttctgtatattaaggcaaatattaaaggcttattaaaaggcctcgtcgggttgttttcagagtcaaaggactctgaaatgcttaatgcttaagaaacagctgatgggggtgggagaagtgtaaaatctttgggagatttggatactggtaatgccatgtggtgttggtaggttaattccagtgtttctttcaatgaaataggcactatggcatcagtaataaaaactgtgaagtagattgttgaaaattgacctgtttcctatttagtgacttgggaaaatggtaaattttgtggatgttgagaaacaataagtgttatactcttacttgaaaaacaacttttaaaaggaaacattatacagtatttatttaaatattttacttctccatagtcctggaagagtactcaagtctattaagttttgctttggagtaaaagactaaattttgagcccttgatcagtatatatattcatttctgctaatgataaattaattgaagaaagcattccatgttttattgtatggcaacacttttatgtgctataaattagtttctctcttctctaaataactaataatacatcttaatttttaattcccttttctttgcttatttctcctgattttcccttcagcccttgggagtctaaatttgtgctggtcagtctggtggccatgagccacatgtgattatttaaattaaaagtagttaaaattaaataaaattcaaaatttggtttctcatttgcactagccacatttcaaatgcttagtaaccacctgtggctagtgactgctataattggcagcaccgattatggtgttttcccctcattgaagaaagttctgctggaaggcactgttctaaattgtcaggacaacttaaaaattctttgggcatatcttcctgtatctcagagtatgcatatatatttcacttaaattttcctcttctattatttcattttacttttctgtttttcagtttaaaaggatgcttaatcgggagctcacccatctctctgaaatgagtcggtctggaaatcaagtgtcagagtttatatcaaacacattcttaggtgagaataacaacatgcaattaaatttttttcttcagttgtttgcttgtttgtttttgtaggaggattggggtgccaactcattttggaaaccaaacaagtgttagaagttctatttgttttcattcgtcatattaataattcgacactatccgcctctgagttttagagttgcaggtgacaaggtacattttcttagttttatttaggactttaggaattcttgaattaagattatatattgccattttttcatagtaccaaactgtaaaatatattttatagagagatctattcatatcttcaacaaattcttattaaatgccagccattgttgggcaataggtgtttaatgataaattagaaatgattcctgccctcgatgaatttaccgtcttgtgtacatcaagcctagtaaactggtgggcagataaaatacaattgctaaataaaagtttgctaataatagctgagtttggtgtcctgggacaactcttgtacctcatccacagaaagaaaatgcagtaaataaaggtcagtaatttgaatgtatcctggacttactttcaaaacaaaattgctgttatatatagttaacatttattaaacacttagaatatgttctatatataaggatgagttagagttgctcatcactgccttgaaatcgtggatgaaagtaagaagatatcttaggtcttttactatagaacacaattagcttatgtacgtattcacttatcaggtaatatttatgattctctatgctcccataaaacctggggatttaacccttatctcactatcatacagaaataaaaagtagcagaattaatctaagtcatccaaaacctgctgtttcagctcccacagtgttacccatttcagttagctgttagttttatatactgctgttttcatgacatttgcgtataaagtttctaccatttcaaagtatgtattgaaactgtagtccttagttggcaagaacaatattcagttcattaagtcagtttcacaaaggaatggaattgaacagtggaaataaccacctgttgtgtattctgagtctgctgtcatgctaagtcttgcagcattttttattaggacattgtatcaaagaggtaaccatggaatacatttgatattattattttgtaatggaacttatttgcttaattttgtgtttgaagacatcaaattaagtccaattcaaatgtaaatactgaactctctaaaaggaaactttttagttggaaacatttcctggaatatataatgatcaattataatccttccaattatgcatatgatataaaacagatagaattaataataaatatagaacattttctaaatttctcaagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggtatgatgatttcaaagatcaggatcataaatattaaatgatgccctttcatgaattttcacttctagtcttttaaatggatagaaaagtttattaattggggttttttttttttctttttttgaagatgggaaggcattttataaagctccttttaaagtgccttagacaggtggtttggtatgttttaggggtttggggggtgattatttgcatcttcatttcattgtttggccttaaagagttagaaatctgtcatgtcttctgggttttaggaaaacagttaaggttttgtgaatagattttatccattaaagaagtgctttgtgattgatacttaaaaagtacataaatgtgttgtaatgtcaaagtcacaaggttaagccatactgttcaattttcagtacatttaagtaaatgtgcctaaagtttgcctatgcttacatggtgtgtctgttaacatttaaaatgaatcattgtttaaaacaatctaacaatctttacactgaagtctgttttgttttgttttgttttgtttgttttgagacatagtctcgccctgtcacccaggttggattgcagaatgcagtggcgcgatcttggctcactacaacctctgcctcctgggttcaagcaattctcctgcctcagcctcccaagtagctgggattacaggcacacaccaccacacctgactaattttttttatttttagtggagatggggtttcaccatgttgggcaggctggtttcaaactcctgacctcaagtgatctgcccgcctcagcctcccaaagttctgggattacaggcttgagcctctatgcccggccacctaaggtctgtaatttttaaatgattgtgttcattgagtcatattttactccactttctaatattttagtatctttttttttttttcactccaggaactagaagatgtgaacaaatggggtcttcatgttttcagaatagcagagttgtctggtaaccggcccttgactgttatcatgcacaccatttttcaggtaaggtggttgagttctattacatttattttatttaggaacttaatgtccagtctgtagcttatgcatacattttgtcttttttaatattccccaccttttgcttatttttatacttttatccttatttgctcctttgccaagggacaagtaaagatacagaaaggtggagtgtggataaaccacaaataacatcaattttgttattttttttgcatttaagaaaaagatgtgatatagccaaattgaagcaatttattaaaataataatttagacatcatcttagtcatctgaacctgactgcatagagaatggagtactaacttaaaaaaaatgaataaagcccctgctggctactaaccttagaatatagttttttcagtcactttcttgtgtcctgcttctttcttcatatccatttctctctcttattgaccctttgctccagcttagggtgggatttaaatgagaagttgaggctgctgtagatatctcgggaccgaaatgggaaacttcagccctagagaggacgttgatttttagttggtgtgatgcaggggttgagttaatagtgcttgactggagctgcctccatgataatgggacatagaaacttttagagttggcacctcattcctgacaccatacagctagggcgtagtattcttgggttccagcaggacaacccaactctggttttgtcccagagtccctggatcttctcagaggttcccattttcctcactagacatgtgagagtgcagttgccatttccaggttatccactggcaacactggtgtgtgatttttttttttaaacatactctatggagaaatttttcacataaagacaaaaatgttaagatgattttttttcctacaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggtaaatctgtttctgaaatttcaagaacactaacttgccactcataaaggtctattaaacttttatctgaagggttttcaatggagaagataattggattcattggaagtataacttattgacttatgggggaaaatgctatagttaatagacaatcaagtctttgatggattttgcttatgaaagttggtcacagatttagtgattgatctgtttatgatattgcttctttgaaatgatccactgaacatttcataaagcacatctggcttactcactttttgttcatttgttttcttgaaatctagtctgacggcttttatttataggccaaagaacgttttataaaacataagcaatatattgatattttttcatagaatatattagaaggacatactttaatttttctaaatcctaagaagttatttcattagttgtttactaaagcaatttgattttcttaagaaatatattttataattcagtttgttttcattataaaattatgttaatacctcatcatatgggtgagtgattctcaactggagatggtttctcttcccctttctttccctcctgccaccaccagggacatttggcaatgtctggaggcatttttggttgtcacaactatcacatttttagttgtacatgatactggcatcttgttggtagaggccaggaattctgctaaaaatcctacaatgcacaggacagcctcccacgcaaagagttattgggcccaaaatgtcaatagtgctgaagttgagaaaccctggtttcgatgaaagaaaataattgctaatgtcttactaattttatgtacattttcagaatattcttagacatcttaaatatttagaaaataaactattattttcttttaaaataatttcagagttttaaaataatattttaaaaaatacagtgaatggaaaacatttgatcatgagatgtaataaaattagataaaatattttcttccaagattatactttaaaagttcacaagtatctaagactctcccttgacacattgtaacacattttgaagcttcattttgttttccatttaaattctagagatttcttatttgtttatacttttaattcatatcattgtagaatagtaatattatctatattgtctgattttccaggctgtgtttacagatttggagattcttgcagcaatttttgccagtgcaatacatgatgtagatcatcctggtgtgtccaatcaatttctgatcaatacaagtaagtaaactttattttttcagaacacatttttcccttgtacattttagaatgactaagggtctttataaactcagagtcttccagagccataatgttcttttgagatgtgtatatatgtgttttagtgatagttcatgttaatgtaatttaactgaaaattatcattatatcccttgaggcatgtgatatttgaaaaatgtgttccagttctctttaaaagtaatatattgctgtgttactagacaagggtaattaaaaatgaaagtgtgcagaaagatttagaaagttgtattggccctaaagttttaaattaaaaaaaaagttatgagaattaatggtaagtgttcctcactttatgtaggtcatcatttaatcctcttcagaggccatagcttcccttcctcctccatgcccaacccctgttctttcctttttaaaatcttctaataagggtaacaggaacttcttaatattttttcaaccatttggttttttctcactgttaacatctcaccttataagaagtcatcactgaatttggaaatataaggaatagtagagactgtttaatatggagcatctctgacattgccgcacagaaagcctgtgtagggaatgtttaggtaatgcttgagctatcccttggtaaagagatttaggtttatagaaattctatttggtacttgaagttaattggtaagtgatttaagtgaactatgacttaattccctcccatatggtagattataaattatggtagattataaaatcataaattcacttttatatataaaaaatatgcaaagttgttgaaaatgttgtatgcttaagaatccacctttctttcatttttgcttgaggctatgaataatagtcttctcgtgcctatagcaatctagctatagaattatttatgaattcaccattcatttcctgtactttgctgtagccagatttaaagaaggaatgtagaggtaaccttgctttgagagatttaattcagagctttaggattatttacctatttttatatcttataatggcctctggactatcctatagcaaaatatactctaatgactcatccatgtagaggactggaaaagtcagggatttcctgagatgtgtggttagtcaagtatttttttacaagtttagtttaggaacttatttatccagattagacaggataacatttcatgttctacctacctatgagcacctataatgaggtacttttagaactcatcaaagcatacatacaaatattaatatacattggatgcagctccctgcatttacatggtatcagtggggaggtatcagtggggagggttcattatgtcctttctaagaagagcagggaggtcatgcaatacagtgcatgctggcactttacatgagcctggcctgatttattttgatgcttatgaatgtcttgagatattctgaattttatcaatttttagtaaatacataaaatgtatttttacataaaatttttgtgttaaaggtatatatatatatctatcttaaacaccaaacattcaaactggtatgttttctttgcattctgttatatagcatattatatgttcccttagaattaagagtagatttagaagacaaattaaaacaactgatagaaaggtcactgtcttccaagtactctgatacattttttaagggtaatgaggacctgctctattcttcattcttttgagcccttaaagcagcagtctccaatgtttttggcaccaggcaccaggttttatggaagacaatttttccataaactgggggcgcagggagagaatggttttgggatgaaactgttccatctcagatcatcaggcattagttagattctcataaggaacgcacaacctagatcccttgcatgagcagttcacagtagggttcacgctcctaggagaatctaatgtccctgctgatctgacaggaggcggagctcaggcagtactgatgcgggcttgcctgctgctcacctcctgctgtgcagcccagttcctgacaggccacggaccgatattggtccacagccgatggatggatcggggacccctgctttaaagggcacttgggctttgactggcacctggaggaccctggcatcagggtccctgtgcagtctgccatttaagctaacaaggcctcagtctacagatgaatctgatactctaaagtttgagaaccaatgaaatagtggaggaaactgaagaagataattttatctccttaggatgtctgtttaaagtcattttgctggtgacctgcctgggatggaaggataactaatcctgccgctgcaaattctttctttgttatttagtaatattgcaatgatctcctttctgtgtgaccacagcgacatagggaagttcacagttgccagagtagctttggattgctaaagtttttttgacgatgaggtgtgatgaggctgtgttattcctgagggaatgaatcagcattgtcactttgtacaggaaagtatcccagggttgttccgggccccagggcattatcaaaattacagccttagttagtttggtttggctagggatcatgtaagagaattatcttcccagcatgcagtaaaggaatccttctaataacttgtaaacttgtgatatgtagcttcgtgaaatattttatcaaaatttgtgcttatttttagtttgcagtaaaccttttttaaaatttgactttttatattttatggatggcttgagcatccatgtgtcaagccagcacattctcagctcttgcctcagagctggagctgccatcctgtccaaagcctgcagctgaatccatatttctcataataaagaattctaaagacctctgattatcaaatttataaacccatagttggttacttgtcttactttaaggaagctacggaagcactgagagcttaaggcacatggggggcgctggggattcccttggctggttcccagggcagttaatcctcctgcttcttacatgtgctcttcgtttttcttaattatttcagttgttttagctttaggtgccaaatgattttatactaattgtatttacactcgttgaaagcatgctggaggttctgcaagcagagagaacaattctacctggtagagttggttaagctataataaatgatttgagtgtgggtactgtgaacaggatttagagaaattgaaatttcaggcaggaagctgcgtaaatatttttaaaggatgatgcatataaataaatccataggccaggtgcagtggctcactcctataatcccagcactttgggaggtcaagatgggtgaatcactgacgtcaggagttcggagaccagcctggccaacaaggtgaaaccctgtctttacaaaaaaaaatacaaaaaaattagccaggtgtggtggcgcatgcctgtattcccagccactcaggtggctgaggcaggagaattgcttgaacctgggaggtagaggttgcagtgagccgagatcataccatcacactccagcctggacaagagtgaaactccatctcaaataaataaataaataaataaatccataaaatgtaaatagcagcatgaacttttgaatataaaatgctggagggtatatttaacttagctttattttctgaaaaaaagtatcaaaagtacagaatatagcattaaattttacttggcaaatgaattatttttgttaatagcaaagatgcctaagtttggggcagaaagatttattcacattagtgatgcattcaaagcatgcggtttttggtttccaagagcagaggcatttcattatattaaggttaagatgtatctagctgtcagtatacacttttttatttctctacttttattttgaaattaaaattttcatagctacactagtagattgtatgtagaattttatttttctgtataaacccacaccttcaaaataaggataaattcatgtttatcaaatgtgattatatagatatagctacagagattattttattcaacaaaaatgtactgcaagcctactaaatgttataataaatattatttcaggcacttaggacacatgggtggacaagacaagacaaatccctggctcttaagagctggcattctgctagaaaaggtggagcataataagtgaatttatggcatgtgatggtactaagtgctatggaggaaaataatgcagggtgagggcatagagagtggagtgatgaatgaggcagttttcttgacaactgaatattaagttaaaaccaccacttccctctgtcatttcatggagaaatgtttgtttctgaagtccttttgaagatttatgtttatttcagttgtaacttagagacatggtgtagcatgctgtcattttctaactaactcaaggctaagcctagtaaagctgtaagaacagtgagtgtaagtcttacttacaggatacatatctatagtgtctgccccagtcttaactgtttcagctccaggtcttaatattggctctgatctgccatgtggactccatcataagacacaaaaaggcacaatacctagtggacttagttggatttgggaggcaatgtattccttctttgtgtgtgttactctggcccatttactaagtgatctgaaaagctgctagtttagatggggcacagaacaagagagtgtcacaaaaactgctagttttgagtggggctctacaacaggtccagcctgctgtgcaagctgctctgcacatgggccacatgatccagcagatttaatggtgcttgaaatgtcagtggcagataggaatgttgtttggagcctttgacagagccctctgtgtgaatcacagcacagactctggagcaagaccctgccatcatccaaagaaagataactaactactctccttttgaaagaaagatataggcctgctgctgggccttaggagatactgactgactatgggccaccaagtttccatgtggtttaagctgtctgcccatcattaatagggtattatctaacgcgccaagccatatgttgggcatgtacgacatttcatcatcaaataaaagtagtgtaatacacgatctatcaggtccgagcagacactaaaggcacaaattacataaagaagtggccctaatgccactcctattaattacactgccttctttctcccagcctacacatgtggtcgcatggaaagttccctgcaagtagttgacagagggcctggtttacggatggttctgcgtgatacgcaggtaccaccggaagtatacagctgcagcactactgcccctctctgggacatctctgaaggatggtggtgaaggggagtctttccagtgggaagaactttaggcaaggtgactcgttgttcactttgcttggaagagggaatggccatatgtgcaattatataccagttcatgggccgtagccaatgatttgtctggatagtgagggacttagaaggaatatgattggaaaactggtgagaaagaaatttggggaagagatatgtgaatgatctctctgaatggacaaaaaaggaatgctcaccaaagtgtgaccttggcagaggaggattttaataaccaagtgaataggatgacccattctgtagatactagtcaacttggttccctagccacccctgtcatcacccaacatgctaagaacaaagtggccatggtggcagggatggaggtggcaggatgtgcttagaaacatggacttccactcaccaaggctgacctggctatgactattgctaagtgcgcaatccaccagcagcataaaccaacactgaacccccatataacaccattttggggggatcagccagctacctgatggctggttgattacattggaccacttccatggtggaaagggtagcattttgtccttagtggaaaaggcactttctctggaaacagatgtgccttccctgcagtttttctgccaaaactatggtattccatacagcattgcctctaaccaggaactcaccttactggcaaagaagagctgcactgggctcatgcccatggaagtccctagtcttaccatattccctaacatcctgaatcagctggcttgataaattggtagaatggccttttgaagactcagttactcagctaggaggcaagaccttgcagggctggggcaaggttctccagaaggccataaaggccatatatgctctgaatcagcatccaatatgtggtgctatttctcgcataaccagaattcatgggtccaggaatcattggatagaaatgggactgttacgactcataattacccccagtgacccactagcaaagtttgcttcctgttcctgcaaatttatgtgctgctagctagaggtcttagtttcagaaggaggaatgcttctatcaggagacacaacagtgattccgttgaactggaagttaagacctagccactttgagctccttatgcatctgattcaatcatccaagaagggcattacagtgttgactggggtgactgatcctgactaccaaggggaaattgggttactactccacaatgaaggtaaggaagagtatgtgtggaataaggagatcccttagggcatcccttagtattaaccatgccctgtaattaaggtcagcacaaaataacccaatccaggcaggaccactaataacccatacccttcacgaatgaaggtttcggtcaccccaccaggtaaagaatcatgaccagctgaggtgcttgctgagggaaaagggaatacagaatgagtagtaaaagaaggtaattacaaataccagctatgaccatatgaccagttatagaaataaggactataattgtcatgagtattttcttatgaatgcatttatatgtatatatacatatattaagcatatatcttcattttctttttcttattcccttatataacataagaggtattaacttatcttcattttctttttcttattcccttatataacataagaggtattaactttatattagtatttaagtatttattttatatcatagtatttaagttataggctatcaggataagagtaaacattactcaaaaactttactttcacttctggggaatgtgttagtgtgcttttagttgtatgcaggatagttgtagcctgtttggtagaattatggccttatggagattaaatatggttaaaggagatgcttatgggtaccagggtgacaaggggcagaatttgtaatggttaattttatgtgtcagcttgactaggctaagggatgcccagatagctggtaaaacactattttggggtgcgtctgtgagagtgttcctggaagagattagattagcatttgaattggtagactgattaaagaagattgcccttaccattgttggcagggatcagtcaatccattgaggacctcaaagagaagaacaaaacattgggggaagggcaatttgctttctcggagcctggacatacatattctcctgcctctaacatcagggttcctggttgattctctggcctttggacttgctttcctggttcacctttgcagacatgggacttcttggactccataattgcctgagccaattcctataataaataaatgtgtctttttctcacatacacacacacactcatacatatgtctattctatttctctggagaaccatgattaatacagagagagaaaagattagcacagatgaagtacatgttctcagttatgtggtagtacctgcccacccttccccccatttcattagcactcagaagagagggacacaaaagtggtcttcctgccttcagtagtagcatatgttgggcataatttaatttattcttgatgatccagggtagttgtaacaaatgagcacaattgatctatatataataaaatgatggctttgagtttgtaaaggtatgcatggcctctcaataaaaaataaatacttacaaagttgtctttataaatgtgtgccaggcactgagtggactgtgttgatttcctggttcatgtttagtgttcactgctcaggttttcacctctataaggtacttgtaatcatagtcagtataaggtgagggctctagaaactgcctggttttaagtgctggccccagcacttactggctaggtgatgttggcaaagttacctaccttctctgaggtacattttcttcatttgtacaggattatatgagtatgtctatgtaaatatttatgtgtataaaagatgtccccaagggacattttctatcccccagcctatcccaaggacacaaagacttacttcccacctatatggctccatgccatccatgaatggaacatagccttaaaatgtcgataacaacagtatcttcctaaaagagttatgaggattaaatgagatgattcacataaaccatttaacacaatggcacctaaatcctctaaatgttgtgccttgctgtattcctgtttgtactttgtaagtttgaaataattgaagtgcctaggggaagccagataaccaaacatattaaattaataacctttaatattttgtaggggcttaagtctctaagtaggttgggagggtttggggaggaacgattaaaagatttgtagagataaagacaaaaaaggtagaatgcgatacatgctaaatgggtggtacaaagtagtatagaagtttacaggagaaagtgggcagtttcatctggtaattaagaaagacttgatggaagaggtaacttatattgggcttgaagatgaaagggtttcaacaaaaatgttatataagctaacctctttgcccctctgtgctgtgcactgtaccatcctgacagcaactttctgatcattcctgaaccttcaaggactctacttacaagtaatggattagtgtctttgatgaaaatctgctgaggagctgcagactcctacctcccaatttaaatgtgaccatatgccttcagtcctaaagaagagtagaaagttaaataacttccttgagattcagtttcttaaatgctaacatttgttcatttaaaaatcaacagtcaccaccactttcctgtaacagcatctgagatggaagaggctatggaggcctgccagtccactaaggcatcctttcctggcttttctagccaatctggactctttaagtgtcaggagataaccactctccaagacaggccttgccagtattcttggacatctgccctacatgaaaggccctacttatatccagtagaactcagactctttgttgcaccttccatacaacagatcacccttttccttgaaggaagagctcatcatcttattcttttgcagggtcaacagccttaatttccttcaccttcagcttcatataagccaattagggtttttgtaaggctaagtcaattctgttaacactgcttgtctacatgcatatttccttccttaaacgaactctaataattatccagtatctaataattatgccttcctttcaatatatgtttgtttatttgattccactgtagaaatacaataatatgtgctaagaacctatatagttttaaatttttcatttctatatgcttacctatctgtagataaaggttcataaaggcatttatagacactataaaagttcaccagaaactgccttttaaaagataaacactattgttttatctaaagaaaacaaaaaataacaaaaaaatactgtacaaacctactccctactagtctaaacagctctgctcctgtagtttgggagcagaaatttaagtgtgcaaatttgtatttctatagttccgataaaataatagaatttctcagttgaaaatgtcttaagcctctcctctccttcctagctccattaaaatagccattgaatagtattgggtatttctttcttaaaaaaagatatatatttccaaatatattttctatgcattcgttatatattttctatgcattcgttagaaaaaagatcaaatacctgtgcttttaacctttttcttttcttttcttttctttttgaaacagagtcttgctctgttgcctagtttggagtgcagtggcacgatataatggctcactgcagccttgaactcctgggctcaagcaatcctcctacctcagcatcccaagtagctgggactacaggcacgccctaccatccccagataattttttattatttgtcgagatgaggtctccctatgttgaccaggctggtcttgaactcctgggcttaagcaatcctcctgcctcggatttgcttttagtctttacagtgattaagtggaaagagaataaagcatcaaaagttttttaatgattatcttgtagctctgggtctgctatttacaagaagtaggagagaggcagaatctctccctgcctaaaattcacaggtctagggcagtagggagagagtggcagaatcttcaccagagggtatacagacagccaaacacaacatcactgtgaagctgtgagcaagcaggcaggaagagcaatatccctgtacagtatacaatgactgccacgatacttggaaaagaaaatggaaaacaatgaataaagcttggactttcagagctatacatgagcaaatgagcaaatctaaacttgttcatatgattccttattgttcttgtaccctctttgagtacaaacaatcctgtaacacaggatcctcactttatatagtgcagggtaggtaattcacagttatcaggaatacaaaaccttatgctctggatgtgttatagatactaagaataatgtcatattctgctgagctcatggcaactctagaggagaggttaaagatccaattctttcactttagagaaagctgagacctacagagtgaaatgacctgccacatgttagtagcattagaattcactccccaagattcattccagtgttgttcctgctcttatgttatctgatttattctctcctggatattgtcaggtaatgataagggcagcagagaagtttaggggaaattacatcctaaatccagaattttaagaatcagataaacttctcacaaacagttttgctgatctttggccttttgtcttttttacagactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtaagtagctgataaaagccaaagaagagaactgtgatgcaagttgtttataatttagacataagaacaagatgagtattaggtaaaaggaactgcatttcaaaacatattatggccctttatgttatagaagctgcccgtgatgctggctgtgatgttctgtaataggtttttcacttctagcagtttggacttgagaataatgtcagctcaccctcatcatttattttctgggcccctccagtctggtggcgggcagagaaaaatgactaacaaaagcagattgtgtgggccacagctcaaatggattttttccccaccttttctcatcagtagacagtgccatttagacatccatgactttactcttttttctatgcatcttattcagtgattatgagacacaggaaaatctctagctttcaaaaacttataaacttgtgatgatgtcttatccatggagatgtcacccatttttcaccatgaaagtggttgtcagtgcctagcatttctgtatattacacacatttatctgggctttgggaaaacttgatagcaaaggggaaaagactctgcccccaaggagtagtaaggattttccactgtcattaaaaggcatagtgttgttttattcctttttcattcttatattctgcgtaatattttcatgtgtaaattctgttttctctgaacttaataatatactctatattttaaggtacttgcaacagatatgtcaaaacacatgaatctactggctgatttgaagactatggttgaaactaagaaagtgacaagctctggagttcttcttcttgataattattccgataggattcaggtaaagccttgtttgagtttgctctgtgtgtgtgtgtctgtgcacatgtgcacatgtctgcgtgttcagctttgataagatgtatttcttccttctcccaccttatactttcagcaattgtaggcaggatttttatccaaatttttattcctgagaattaaccaggtaaaattctactggtctttctgtttgcatctacattaattaaaaaaactaacaaacaaacaccccacagaaccagccacttaagcagctctgaatctagtcagccatgcacataaacagtttctcttaagctatttagatgcagtagaagtggcataatttggaactattaatacaagtgtgaactatacacagacacatcatggttgagctgtttggaataaatcttacactacgtgtatttttaagtgttgcagtcatccaatgtgaatttctagttttttttgtttttttttttaaaaaaaaggaacaggagtgaatagagaatgcatccatctattttaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtaatgcatgaagtgtatagctttcagagagaacagagctaccgctttagcatttggttactttgtattacatatgatagtattttactggatttttaaaattactttgtttttgacaagctcaatttcaccttagtatttatgatccaaagaactttcattcttatgacttacattcatatagtcatatatatattctaaagacatattcatttattatgactatattcatttaatatattcatatacatagagcacatggcattatttcagttatctggattcacctacaaattggtgattgtaaaataagccctaccatgtcaacaactggaaaattttttatgctatagaacatgctctttaaccaaaggttctagaagctaattttgaccagctagtagcaatactttactttaaatggtctgttgttgttgaaaatagtgacaattttaccaaactaagtttagtagtcttctgttcagtgttttatttgtgggccatgatctaattaagcttttccattgtttcttagtcccaagtcctctactcatactggatttttttcttaactaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgtcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatacttttatgtgtgttatatcaaatgtgtcttaagcttcatgcaaactcagtcatcagttcgtgttgtctgaagcaagtgggagatatataaatacccagtagctaaaatggtcagtcttttttagatgttttcctacttagtatctcctaataacgttttgctgtgtcactagatgttcatttcacaagtgcatgtctttctaataatccacacatttcatgctctaataatccacacatttcatgctcatttttattgtttttacagccagttatagtaagaaaaaggtttttccccttgtgctgctttataatttagcgtgtgtctgaaccttatccatgtttgctagatgaggtcttgtcaaatatatcactaccattgtcaccggtgaaaagaaacaggtagttaagttagggttaacattcatttcaaccacgaggttgtatatcatgactagcttttactcttggtttacagagaaaagttaaacagccaactaggcagtttttaagaatattaacaatatattaacaaacaccaatacaactaatcctatttggttttaatgatttcaccatgggattaagaactatatcaggaacatccctgagaaacggttttaagtgtagcaactactcttccttaatggacagccacataacgtgtaggaagtcctttatcacttatcctcgatccataagcatatcttgcagaggggaactacttctttaaacacatggagggaaagaagatgatgccactggcaccagagggttagtactgtgatgcatcctaaaatatttattatattggtaaaaattctggttaaataaaaaattagagatcactcttggctgatttcagcaccaggaactgtattacagttttagagattaattcctagtgtttacctgattatagcagttggcatcatggggcatttaattctgactttatccccacgtcagccttaataaagtcttctttaccttctctatgaagactttaaagcccaaataatcatttttcacattgatattcaagaattgagatagatagaagccaaagtgggtatctgacaagtggaaaatcaaacgtttaagaagaattacaactctgaaaagcatttatatgtggaacttctcaaggagcctcctggggactggaaagtaagtcatcagccaggcaaatgactcatgctgaagagagtccccatttcagtcccctgagatctagctgatgcttagatcctttgaaataaaaattatgtctttataactctgatcttttacataaagcagaagaggaatcaactagttaattgcaaggtttctactctgtttcctctgtaaagatcagatggtaatctttcaaataagaaaaaaataaagacgtatgtttgaccaagtagtttcacaagaatatttgggaacttgtttcttttaattttatttgtccctgagtgaagtctagaaagaaaggtaaagagtctagagtttattcctctttccaaaacattctcattcctctcctccctacacttagtatttcccccacagagtgcctagaatcttaataatgaataaaataaaaagcagcaatatgtcattaacaaatccagacctgaaagggtaaagggtttataactgcactaataaagagaggctctttttttttcttccagtttgttggtttttaatggtaccgtgttgtaaagatacccactaatggacaatcaaattgcagaaaaggctcaatatccaagagacagggactaatgcactgtacaatctgcttatccttgcccttctctcttgccaaagtgtgcttcagaaatatatactgctttaaaaaagaataaaagaatatccttttacaagtggctttacatttcctaaaatgccataagaaaatgcaatatctgggtactgtatggggaaaaaaatgtccaagtttgtgtaaaaccagtgcatttcagcttgcaagttactgaacacaataatgctgttttaattttgttttatatcagttaaaattcacaataatgtagatagaacaaattacagacaaggaaagaaaaaacttgaatgaaatggattttacagaaagctttatgataatttttgaatgcattatttattttttgtgccatgcattttttttctcaccaaatgaccttacctgtaatacagtcttgtttgtctgtttacaaccatgtatttattgcaatgtacatactgtaatgttaattgtaaattatctgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttgcatttgattatttcctttttttttttttttaactcggaaacacaactggggaaatatattctttcccagtgattataaacaatctttttcttttttttaagtccttttggcttctagagctcataggaaaatggacttgatttgaaattggagccagagtttactcgtgttggttatctattcatcagcttcctgacatgttaagagaatacattaaagagaaaatactgttttttaatcctaaaatttttcttccactaagataaaccaaatgtccttacatatatgtaaacccatctatttaaacgcaaaggtgggttgatgtcagtttacatagcagaaagcattcactatcctctaagatttgtttctgcaaaactttcattgctttagaattttaaaatttcaccttgtacaatggccagcccctaaagcaggaaacatttataatggattatatggaaacatcctcccagtacttgcccagcccttgaatcatgtggcttttcagtgaaaggaaagattctttttctaggaaaaatgagcctattttattttattttattttattttttgacacaaactgtagattttagcagccctggcccaaaggaatttgattacttttgttttaaacagtacaaaggggacactataattacaaaaacatccttaactgatttgagttgtttttatttctttggatatattttcagagtggtaaattgtgtgtgagaattacaaatgattattcttttagtggtttcttagcctctcttacagcccacggggatagtactgtacatcaataccttcatatgaaatttttatatgcaatgaaaataaaagcatgggttgattctgcctatttatgactcaatcttttacaaataaaagattattcattttaaattatagttcaatcagcatgtctcttaggatactgaacgtggttgaaatgaaaggatagtgacatcataagttagtactgatattcataaccaaataaagccaacttgagtaattttgctacattaaaaattaccaaaattacttagatggcctataagattaagcatggtgttttctaagcaagctttgaaaggggccttccatacttacttaattgaatattctgggatattgaaaattattcagatacttgacaattatttttggttacctactccgcaaactacaaagttttaaggactcaacaataagttaatgagacacagtgtttgctttcatggagcttacagtctggaggggacaaaggcttaaacaatactcatataattatatatgtgatcagtacaatgaaggagctcagtggggtaaataagcaggaacctgaacttgatctgttccggagggccacagaaggcttccttgaggccttgagaaagtgatttgcatctgagttctgaaggattgtaagaggtaactagggaaaaagttgacaggaagaggaaggggatccagacaagaaacatttgcaaagatcttgaggcataaatgagcttgagacatctggagaaactgaggaaaagtgagagagtaggcagggcctggagccgcagagccattgctaaccatcctgtgtgagatatcccccattctgtagctttattctcataaccctgctcaattttctttataacacttctcacagatttatatacgtgtttgtttttgttatctgtctctcccaccagaccacagctccatgagagcaaggtctttgcttaccaatatatcactagcacttaaaactatgcctggtacacagtaggttcttaatatgtgttgaatatagccatcaaattgatattggatataattcaatctgataagatattttgagatattaaagagtttttaacttgataccataaaaactttgtttgttttttgtttttgagcttactaagatcctggataaagagtttagagtttcctatctctttgctaactaaaaactctgtttgcttattcctcacaaattctacttttttctaaatgacaatccatttgtcatgataatgagagtaaagaaatcagcacaaatttaatccccagatcatccccagaccatgccagcagaataagggtaattaaacagagcatctatgcttagcctctccaccatttctcctgccacaacagtcctgacagccaacaggtgccaaatttgtgccttcctgggaataactgttttaaactcaagctcccttccccaaagccatgaccccaaagtgacactatggaactaaggaagcaactcccttcttttcctgacttgccacgcttgctgatttaggctaatttgggtggtggtgggcctgaactcacattaaaatctctgacctggaaacctttcctcaggcacacggctttggacccacaacagcaacattccaccaaaaaacaaaccaaaaccaaaaacattccctgttgctagagagtaccacctgtctaccaaggggaaaac

SEQ ID NO: 20 - DNA, 21 bp, Artificial Sequence
  PDE4D1D2_forward primer
aatatgaaggagcagccctca

SEQ ID NO: 21 - DNA, 18 bp, Artificial Sequence
  PDE4D1D2_reverse primer
gtctcgctggccagtttc

SEQ ID NO: 22 - DNA, 18 bp, Artificial Sequence
  PDE4D1D2 probe
catccgagcatggcggga

SEQ ID NO: 23 - DNA, 19 bp, Artificial Sequence
  PDE4D5_forward primer
gcttctcagcagcaacatc

SEQ ID NO: 24 - DNA, 20 bp, Artificial Sequence
  PDE4D5_reverse primer
tgccattgtccacatcaaaa

SEQ ID NO: 25 - DNA, 24 bp, Artificial Sequence
  PDE4D5 probe
acagcggcgtttcacggtggcaca

SEQ ID NO: 26 - DNA, 20 bp, Artificial Sequence
  PDE4D7_forward primer
gaacattcaacgaccaacca

SEQ ID NO: 27 - DNA, 20 bp, Artificial Sequence
  PDE4D7_reverse primer
tgccattgtccacatcaaaa

SEQ ID NO: 28 - DNA, 27 bp, Artificial Sequence
  PDE4D7 probe
ctgccgctgattgctatcacttctgca

SEQ ID NO: 29 - DNA, 26 bp, Artificial Sequence
  PDE4D9_forward primer
atgagcattattatgaagccaagatc

SEQ ID NO: 30 - DNA, 22 bp, Artificial Sequence
  PDE4D9_reverse primer
gtgccattgtccacatcaaaac

SEQ ID NO: 31 - DNA, 27 bp, Artificial Sequence
  PDE4D9 probe
ctacaagttccctaaggactgcagagg

SEQ ID NO: 32 - DNA, 1921 bp, Homo sapiens
ggcggaagtgacattatcaacgcgcgccaggggttcagtgaggtcgggcaggttcgctgtggcgggcgcctgggccgccggctgtttaacttcgcttccgctggcccatagtgatctttgcagtgacccagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcaacagcaacagcagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaatatggtggggagctgtgatgtgaagtttcctataaggttagaaggccttgtgctcacccaccaacaatttagtagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgttagattgttgttaaaaaaaaaaaaaaaaaa

SEQ ID NO: 33 - DNA, 1435 bp, Homo sapiens
ggcggggcctgcttctcctcagcttcaggcggctgcgacgagccctcaggcgaacctctcggctttcccgcgcggcgccgcctcttgctgcgcctccgcctcctcctctgctccgccaccggcttcctcctcctgagcagtcagcccgcgcgccggccggctccgttatggcgacccgcagccctggcgtcgtgattagtgatgatgaaccaggttatgaccttgatttattttgcatacctaatcattatgctgaggatttggaaagggtgtttattcctcatggactaattatggacaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtaatgaccagtcaacaggggacataaaagtaattggtggagatgatctctcaactttaactggaaagaatgtcttgattgtggaagatataattgacactggcaaaacaatgcagactttgctttccttggtcaggcagtataatccaaagatggtcaaggtcgcaagcttgctggtgaaaaggaccccacgaagtgttggatataagccagactttgttggatttgaaattccagacaagtttgttgtaggatatgcccttgactataatgaatacttcagggatttgaatcatgtttgtgtcattagtgaaactggaaaagcaaaatacaaagcctaagatgagagttcaagttgagtttggaaacatctggagtcctattgacatcgccagtaaaattatcaatgttctagttctgtggccatctgcttagtagagctttttgcatgtatcttctaagaattttatctgttttgtactttagaaatgtcagttgctgcattcctaaactgtttatttgcactatgagcctatagactatcagttccctttgggcggattgttgtttaacttgtaaatgaaaaaattctcttaaaccacagcactattgagtgaaacattgaactcatatctgtaagaaataaagagaagatatattagttttttaattggtattttaatttttatatatgcaggaaagaatagaagtgattgaatattgttaattataccaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttcccttttaaatgcaaatcaataaattcccaaaaatttaaaaaaaaaaaaaaaaaaaaaa

SEQ ID NO: 34 - DNA, 1852 bp, Homo sapiens
accgccgagaccgcgtccgccccgcgagcacagagcctcgcctttgccgatccgccgcccgtccacacccgccgccagctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcgttgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacaccttaaaaatgaaaaaaaaaaaaaaaaaaaaaaaaaaaaaaaaaaaaaaaaa

SEQ ID NO: 35 - DNA, 1229 bp, Homo sapiens
gtctgacgggcgatggcgcagccaatagacaggagcgctatccgcggtttctgattggctactttgttcgcattataaaaggcacgcgcgggcgcgaggcccttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttctttaaaaagtaaaaaaaaaaaaaaaaaaaaaaaaa

SEQ ID NO: 36 - DNA, 1229 bp, Homo sapiens; identical to SEQ ID NO: 35

SEQ ID NO: 37 - DNA, 6738 bp, Homo sapiens
gagagcgcggccgggacggttggagaagaaggcggctcccggaagggggagagacaaactgccgtaacctctgccgttcaggaacccggttacttatttattcgttaccctttttcttcttcctcccccaaaaaccttttccttttcccttctttttttttcctttttgggagctgaaaaatttccggtaagggaaagaagggctcctttcgctccttatttccccgcctccttccctcccccaccttcccctcctccggctttttcctcccaactcggggaggtccttcccggtggccgccctgacgaggtctgagcacctaggcggaggcggcgcaggctttttgtagtgaggtttgcgcctgcgcagcgcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagtgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggggtgaagtgatgaacctcctgatgttcctgtcgacgtgggatgggaaggtcccacagccggccatcctaaagccccggcccctgtggacaggcaagcaaatcttctccctcatcatacctggtcacatcaattgtatccgtacccacagcacccatcccgatgatgaagacagtggcccttacaagcacatctctcctggggacaccaaggtggtggtggagaatggggagctgatcatgggcatcctgtgtaagaagtctctgggcacgtcagctggctccctggtccacatctcctacctagagatgggtcatgacatcactcgcctcttctactccaacattcagactgtcattaacaactggctcctcatcgagggtcatactattggcattggggactccattgctgattctaagacttaccaggacattcagaacactattaagaaggccaagcaggacgtaatagaggtcatcgagaaggcacacaacaatgagctggagcccaccccagggaacactctgcggcagacgtttgagaatcaggtgaaccgcattcttaacgatgcccgagacaagactggctcctctgctcagaaatccctgtctgaatacaacaacttcaagtctatggtcgtgtccggagctaaaggttccaagattaacatctcccaggtcattgctgtcgttggacagcagaacgtcgagggcaagcggattccatttggcttcaagcaccggactctgcctcacttcatcaaggatgactacgggcctgagagccgtggctttgtggagaactcctacctagccggcctcacacccactgagttctttttccacgccatggggggtcgtgaggggctcattgacacggctgtcaagactgctgagactggatacatccagcggcggctgatcaagtccatggagtcagtgatggtgaagtacgacgcgactgtgcggaactccatcaaccaggtggtgcagctgcgctacggcgaagacggcctggcaggcgagagcgttgagttccagaacctggctacgcttaagccttccaacaaggcttttgagaagaagttccgctttgattataccaatgagagggccctgcggcgcactctgcaggaggacctggtgaaggacgtgctgagcaacgcacacatccagaacgagttggagcgggaatttgagcggatgcgggaggatcgggaggtgctcagggtcatcttcccaactggagacagcaaggtcgtcctcccctgtaacctgctgcggatgatctggaatgctcagaaaatcttccacatcaacccacgccttccctccgacctgcaccccatcaaagtggtggagggagtcaaggaattgagcaagaagctggtgattgtgaatggggatgacccactaagtcgacaggcccaggaaaatgccacgctgctcttcaacatccacctgcggtccacgttgtgttcccgccgcatggcagaggagtttcggctcagtggggaggccttcgactggctgcttggggagattgagtccaagttcaaccaagccattgcgcatcccggggaaatggtgggggctctggctgcgcagtcccttggagaacctgccacccagatgaccttgaataccttccactatgctggtgtgtctgccaagaatgtgacgctgggtgtgccccgacttaaggagctcatcaacatttccaagaagccaaagactccttcgcttactgtcttcctgttgggccagtccgctcgagatgctgagagagccaaggatattctgtgccgtctggagcatacaacgttgaggaaggtgactgccaacacagccatctactatgaccccaacccccagagcacggtggtggcagaggatcaggaatgggtgaatgtctactatgaaatgcctgactttgatgtggcccgaatctccccctggctgttgcgggtggagctggatcggaagcacatgactgaccggaagctcaccatggagcagattgctgaaaagatcaatgctggttttggtgacgacttgaactgcatctttaatgatgacaatgcagagaagctggtgctccgtattcgcatcatgaacagcgatgagaacaagatgcaagaggaggaagaggtggtggacaagatggatgatgatgtcttcctgcgctgcatcgagtccaacatgctgacagatatgaccctgcagggcatcgagcagatcagcaaggtgtacatgcacttgccacagacagacaacaagaagaagatcatcatcacggaggatggggaattcaaggccctgcaggagtggatcctggagacggacggcgtgagcttgatgcgggtgctgagtgagaaggacgtggaccccgtacgcaccacgtccaatgacattgtggagatcttcacggtgctgggcattgaagccgtgcggaaggccctggagcgggagctgtaccacgtcatctcctttgatggctcctatgtcaattaccgacacttggctctcttgtgtgataccatgacctgtcgtggccacttgatggccatcacccgacacggagtcaaccgccaggacacaggaccactcatgaagtgttcctttgaggaaacggtggacgtgcttatggaagcagccgcacacggtgagagtgaccccatgaagggggtctctgagaatatcatgctgggccagctggctccggccggcactggctgctttgacctcctgcttgatgcagagaagtgcaagtatggcatggagatccccaccaatatccccggcctgggggctgctggacccaccggcatgttctttggttcagcacccagtcccatgggtggaatctctcctgccatgacaccttggaaccagggtgcaacccctgcctatggcgcctggtcccccagtgttgggagtggaatgaccccaggggcagccggcttctctcccagtgctgcgtcagatgccagcggcttcagcccaggttactcccctgcctggtctcccacaccgggctccccggggtccccaggtccctcaagcccctacatcccttcaccaggtggtgccatgtctcccagctactcgccaacgtcacctgcctacgagccccgctctcctgggggctacacaccccagagtccctcttattcccccacttcaccctcctactcccctacctctccatcctattctccaaccagtcccaactatagtcccacatcacccagctattcgccaacgtcacccagctactcaccgacctctcccagctactcacccacctctcccagctactcgcccacctctcccagctactcgcccacctctcccagctactcacccacttcccctagctactcgcccacttcccctagctactcgccaacgtctcccagctactcgccgacatctcccagctactcgccaacttcacccagctattctcccacttctcccagctactcacctacctctccaagctattcacccacctcccccagctactcacccacttccccaagttactcacccaccagcccgaactattctccaaccagtcccaattacaccccaacatcacccagctacagcccgacatcacccagctattcacctactagtcccaactacacacctaccagccctaactacagcccaacctctccaagctactctccaacatcacccagctattccccgacctcaccaagttactccccttccagcccacgatacacaccacagtctccaacctataccccaagctcacccagctacagccccagctcgcccagctacagcccaacctcacccaagtacaccccaaccagtccttcttacagtcccagctccccagagtataccccaacctctcccaagtactcacctaccagtcccaaatattcacccacctctcccaagtactcgcctaccagtcccacctattcacccaccaccccaaaatactccccaacatctcctacttattccccaacctctccagtctacaccccaacctctcccaagtactcacctactagccccacttactcgcccacttcccccaagtactcgcccaccagccccacctactcgcccacctcccccaaaggctcaacctactctcccacttcccctggttactcgcccaccagccccacctacagtctcacaagcccggctatcagcccggatgacagtgacgaggagaactgagggcacgtggggtgcggcagcgggctagggcccagggcagcttgcccgtgctgctgtgcagttcttgcctccctcacggggcgtcacccccagcccagctccgttgtacataaatgccttgtggcagagctcccggtgaacttctggatcccgtttctgatgcagactcttgtcttgttctccacttgtgctgttagaactcactggcccagtggtgttctcactcctaccccacccaccccctgcctgtccccaaattgaagatccttccttgcctgtggcttgatgcggggcgggtaaagggtattttaacttaggggtagttcctgctgtgagtggttacagctgatcctcgggaagaacaaagctaaagctgccttttgtctgttattttatttttttgaagtttaaataaagtttactaattttgaccaaaagt

SEQ ID NO: 38 - DNA, 987 bp, Homo sapiens
aatataagtggaggcgtcgcgctggcgggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttgatgtgttatctctta

SEQ ID NO: 39 - DNA, 5416 bp, Homo sapiens
agtgggccgccatgttgtcggagtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcaggtaattaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctgaaaaaaaaaaaaaaaaaaaaaaaaaaaaaaa

SEQ ID NO: 40 - DNA, 5410 bp, Homo sapiens
agtgggccgccatgttgtcggagtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctgaaaaaaaaaaaaaaaaaaaaaaaaaaaaaaa

SEQ ID NO: 41 - DNA, 1771 bp, Homo sapiens
ggcggccaggccgggcgcggagtgggcgcgcggggccggaggaggggccagcgaccgcggcaccgcctgtgcccgcccgcccctccgcagccgctacttaagaggctccagcgccggccccgccctagtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccgggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacatcaaaaaaaaaaaaaaaaaaaaaa

SEQ ID NO: 42 - DNA, 2458 bp, Homo sapiens
cagaagaaggcagcgcccaaggcgcatgcgcagcggtcactcccgctgtatattaaggcgccggcgatcgcggcctgaggctgctcccggacaagggcaacgagcgtttcgtttggacttctcgacttgagtgcccgcctccttcgccgccgcctctgcagtcctcagcgcagttatgcccagttcttcccgctgtggggacacgaccacggaggaatccttgcttcagggactcgggaccctgctggaccccttcctcgggtttaggggatgtggggaccaggagaaagtcaggatccctaagagtcttccctgcctggatggatgagtggcttcttctccacctagattctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaacatagtcctggaaataaattcttgcttaaatggtgaaaaaa

SEQ ID NO: 43 - DNA, 2281 bp, Homo sapiens
cagaagaaggcagcgcccaaggcgcatgcgcagcggtcactcccgctgtatattaaggcgccggcgatcgcggcctgaggctgctcccggacaagggcaacgagcgtttcgtttggacttctcgacttgagtgcccgcctccttcgccgccgcctctgcagtcctcagcgcagtctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaacatagtcctggaaataaattcttgcttaaatggtgaaaaaa

SEQ ID NO: 44 - protein, 339 aa, Homo sapiens
MDQNNSLPPYAQGLASPQGAMTPGIPIFSPMMPYGTGLTPQPIQNTNSLSILEEQQRQQQQQQQQQQQQQQQQQQQQQQQQQQQQQQQQQQQQQQAVAAAAVQQSTSQQATQGTSGQAPQLFHSQTLTTAPLPGTTPLYPSPMTPMTPITPATPASESSGIVPQLQNIVSTVNLGCKLDLKTIALRARNAEYNPKRFAAVIMRIREPRTTALIFSSGKMVCTGAKSEEQSRLAARKYARVVQKLGFPAKFLDFKIQNMVGSCDVKFPIRLEGLVLTHQQFSSYEPELFPGLIYRMIKPRIVLLIFVSGKVVLTGAKVRAEIYEAFENIYPILKGFRKTT

SEQ ID NO: 45 - protein, 218 aa, Homo sapiens
MATRSPGVVISDDEPGYDLDLFCIPNHYAEDLERVFIPHGLIMDRTERLARDVMKEMGGHHIVALCVLKGGYKFFADLLDYIKALNRNSDRSIPMTVDFIRLKSYCNDQSTGDIKVIGGDDLSTLTGKNVLIVEDIIDTGKTMQTLLSLVRQYNPKMVKVASLLVKRTPRSVGYKPDFVGFEIPDKFVVGYALDYNEYFRDLNHVCVISETGKAKYKA

SEQ ID NO: 46 - protein, 375 aa, Homo sapiens
MDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 47 - protein, 317 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLVIQQVFDNGSIYNPEVLDITEETLHSRFLEGVRNVASVCLQIGYPTVASVPHSIINGYKRVLALSVETDYTFPLAEKVKAFLADPSAFVAAAPVAAATTAAPAAAAAPAKVEAKEESEESDEDMGFGLFD

SEQ ID NO: 48 - protein, 317 aa, Homo sapiens; identical to SEQ ID NO: 47

SEQ ID NO: 49 - protein, 1970 aa, Homo sapiens
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERGEVMNLLMFLSTWDGKVPQPAILKPRPLWTGKQIFSLIIPGHINCIRTHSTHPDDEDSGPYKHISPGDTKVVVENGELIMGILCKKSLGTSAGSLVHISYLEMGHDITRLFYSNIQTVINNWLLIEGHTIGIGDSIADSKTYQDIQNTIKKAKQDVIEVIEKAHNNELEPTPGNTLRQTFENQVNRILNDARDKTGSSAQKSLSEYNNFKSMVVSGAKGSKINISQVIAVVGQQNVEGKRIPFGFKHRTLPHFIKDDYGPESRGFVENSYLAGLTPTEFFFHAMGGREGLIDTAVKTAETGYIQRRLIKSMESVMVKYDATVRNSINQVVQLRYGEDGLAGESVEFQNLATLKPSNKAFEKKFRFDYTNERALRRTLQEDLVKDVLSNAHIQNELEREFERMREDREVLRVIFPTGDSKVVLPCNLLRMIWNAQKIFHINPRLPSDLHPIKVVEGVKELSKKLVIVNGDDPLSRQAQENATLLFNIHLRSTLCSRRMAEEFRLSGEAFDWLLGEIESKFNQAIAHPGEMVGALAAQSLGEPATQMTLNTFHYAGVSAKNVTLGVPRLKELINISKKPKTPSLTVFLLGQSARDAERAKDILCRLEHTTLRKVTANTAIYYDPNPQSTVVAEDQEWVNVYYEMPDFDVARISPWLLRVELDRKHMTDRKLTMEQIAEKINAGFGDDLNCIFNDDNAEKLVLRIRIMNSDENKMQEEEEVVDKMDDDVFLRCIESNMLTDMTLQGIEQISKVYMHLPQTDNKKKIIITEDGEFKALQEWILETDGVSLMRVLSEKDVDPVRTTSNDIVEIFTVLGIEAVRKALERELYHVISFDGSYVNYRHLALLCDTMTCRGHLMAITRHGVNRQDTGPLMKCSFEETVDVLMEAAAHGESDPMKGVSENIMLGQLAPAGTGCFDLLLDAEKCKYGMEIPTNIPGLGAAGPTGMFFGSAPSPMGGISPAMTPWNQGATPAYGAWSPSVGSGMTPGAAGFSPSAASDASGFSPGYSPAWSPTPGSPGSPGPSSPYIPSPGGAMSPSYSPTSPAYEPRSPGGYTPQSPSYSPTSPSYSPTSPSYSPTSPNYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPNYSPTSPNYTPTSPSYSPTSPSYSPTSPNYTPTSPNYSPTSPSYSPTSPSYSPTSPSYSPSSPRYTPQSPTYTPSSPSYSPSSPSYSPTSPKYTPTSPSYSPSSPEYTPTSPKYSPTSPKYSPTSPKYSPTSPTYSPTTPKYSPTSPTYSPTSPVYTPTSPKYSPTSPTYSPTSPKYSPTSPTYSPTSPKGSTYSPTSPGYSPTSPTYSLTSPAISPDDSDEEN

SEQ ID NO: 50 - protein, 119 aa, Homo sapiens
MSRSVALAVLALLSLSGLEAIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 51 - protein, 1188 aa, Homo sapiens
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQVRSMDELNHDFQALALEGRAMGEQLLPGKKFWETDESSKDGPKGIFLGDQWRDSAWGTSDHSVSQPIMVQRRPGQSFHVNSEVNSVLSPRSESGGLGVSMVEYVLSSSPGDSCLRKGGFGPRDADSDENDKGEKKNKGTFDGDKLGDLKEEGDVMDKTNGLPVQNGIDADVKDFSRTPGNCQNSANEVDLLGPNQNGSEGLAQLTSTNGAKPVEDFSNMESQSVPLDPMEHVGMEPLQFDYSGTQVPVDSAAATVGLFDYNSQQQLFQRPNALAVQQLTAAQQQQYALAAAHQPHIGLAPAAFVPNPYIISAAPPGTDPYTAGLAAAATLGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGAPVRLVAPAPVIISSSAAQAAVAAAAASANGAAGGLAGTTNGPFRPLGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQVINEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 52 - protein, 1186 aa, Homo sapiens
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQVRSMDELNHDFQALALEGRAMGEQLLPGKKFWETDESSKDGPKGIFLGDQWRDSAWGTSDHSVSQPIMVQRRPGQSFHVNSEVNSVLSPRSESGGLGVSMVEYVLSSSPGDSCLRKGGFGPRDADSDENDKGEKKNKGTFDGDKLGDLKEEGDVMDKTNGLPVQNGIDADVKDFSRTPGNCQNSANEVDLLGPNQNGSEGLAQLTSTNGAKPVEDFSNMESQSVPLDPMEHVGMEPLQFDYSGTQVPVDSAAATVGLFDYNSQQQLFQRPNALAVQQLTAAQQQQYALAAAHQPHIGLAPAAFVPNPYIISAAPPGTDPYTAGLAAAATLGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGAPVRLVAPAPVIISSSAAQAAVAAAAASANGAAGGLAGTTNGPFRPLGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQNEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 53 - protein, 451 aa, Homo sapiens [sequence omitted]

SEQ ID NO: 54 - protein, 640 aa, Homo sapiens
MESVVRRCPFLSRVPQAFLQKAGKSLLFYAQNCPKMMEVGAKPAPRALSTAAVHYQQIKETPPASEKDKTAKAKVQQTPDGSQQSPDGTQLPSGHPLPATSQGTASKCPFLAAQMNQRGSSVFCKASLELQEDVQEMNAVRKEVAETSAGPSVVSVKTDGGDPSGLLKNFQDIMQKQRPERVSHLLQDNLPKSVSTFQYDRFFEKKIDEKKNDHTYRVFKTVNRRAHIFPMADDYSDSLITKKQVSVWCSNDYLGMSRHPRVCGAVMDTLKQHGAGAGGTRNISGTSKFHVDLERELADLHGKDAALLFSSCFVANDSTLFTLAKMMPGCEIYSDSGNHASMIQGIRNSRVPKYIFRHNDVSHLRELLQRSDPSVPKIVAFETVHSMDGAVCPLEELCDVAHEFGAITFVDEVHAVGLYGARGGGIGDRDGVMPKMDIISGTLGKAFGCVGGYIASTSSLIDTVRSYAAGFIFTTSLPPMLLAGALESVRILKSAEGRVLRRQHQRNVKLMRQMLMDAGLPVVHCPSHIIPVRVADAAKNTEVCDELMSRHNIYVQAINYPTVPRGEELLRIAPTPHHTPQMMNYFLENLLVTWKQVGLELKPHSSAECNFCRRPLHFEVMSEREKSYFSGLSKLVSAQA

SEQ ID NO: 55 - protein, 640 aa, Homo sapiens; identical to SEQ ID NO: 54

SEQ ID NO: 56 - DNA, 23 bp, Artificial Sequence
  TBP_forward primer
gccaagaagaaagtgaacatcat

SEQ ID NO: 57 - DNA, 20 bp, Artificial Sequence
  TBP_reverse primer
atagggattccgggagtcat

SEQ ID NO: 58 - DNA, 24 bp, Artificial Sequence
  TBP probe
tcagaacaacagcctgccacctta

SEQ ID NO: 59 - DNA, 24 bp, Artificial Sequence
  HPRT1_forward primer
gaggatttggaaagggtgtttatt

SEQ ID NO: 60 - DNA, 21 bp, Artificial Sequence
  HPRT1_reverse primer
acagagggctacaatgtgatg

SEQ ID NO: 61 - DNA, 26 bp, Artificial Sequence
  HPRT1 probe
acgtcttgctcgagatgtgatgaagg

SEQ ID NO: 62 - DNA, 18 bp, Artificial Sequence
  ACTB_forward primer
ccaaccgcgagaagatga

SEQ ID NO: 63 - DNA, 20 bp, Artificial Sequence
  ACTB_reverse primer
ccagaggcgtacagggatag

SEQ ID NO: 64 - DNA, 23 bp, Artificial Sequence
  ACTB probe
ccatgtacgttgctatccaggct

SEQ ID NO: 65 - DNA, 18 bp, Artificial Sequence
  RPLP0_forward primer
taaaccctgcgtggcaat

SEQ ID NO: 66 - DNA, 27 bp, Artificial Sequence
  RPLP0_reverse primer
acatttcggataatcatccaatagttg

SEQ ID NO: 67 - DNA, 24 bp, Artificial Sequence
  RPLP0 probe
aagtagttggacttccaggtcgcc

SEQ ID NO: 68 - DNA, 19 bp, Artificial Sequence
  POLR2A_forward primer
agtcctgagtccggatgaa

SEQ ID NO: 69 - DNA, 18 bp, Artificial Sequence
  POLR2A_reverse primer
cctccctcagtcgtctct

SEQ ID NO: 70 - DNA, 24 bp, Artificial Sequence
  POLR2A probe
tgacggagggtggcatcaaatacc

SEQ ID NO: 71 - DNA, 17 bp, Artificial Sequence
  B2M_forward primer
ccgtggccttagctgtg

SEQ ID NO: 72 - DNA, 21 bp, Artificial Sequence
  B2M_reverse primer
ctgctggatgacgtgagtaaa

SEQ ID NO: 73 - DNA, 24 bp, Artificial Sequence
  B2M probe
tctctctttctggcctggaggcta

SEQ ID NO: 74 - DNA, 22 bp, Artificial Sequence
  PUM1_forward primer
gccagcttgtcttcaatgaaat

SEQ ID NO: 75 - DNA, 21 bp, Artificial Sequence
  PUM1_reverse primer
caaagccagcttctgttcaag

SEQ ID NO: 76 - DNA, 24 bp, Artificial Sequence
  PUM1 probe
atccaccatgagttggtaggcagc

SEQ ID NO: 77 - DNA, 22 bp, Artificial Sequence
  K-ALPHA-1_forward primer
tgactccttcaacaccttcttc

SEQ ID NO: 78 - DNA, 18 bp, Artificial Sequence
  K-ALPHA-1_reverse primer
tgccagtgcgaacttcat

SEQ ID NO: 79 - DNA, 24 bp, Artificial Sequence
  K-ALPHA-1 probe
ccgggctgtgtttgtagacttgga

SEQ ID NO: 80 - DNA, 17 bp, Artificial Sequence
  ALAS-1_forward primer
agccacatcatccctgt

SEQ ID NO: 81 - DNA, 22 bp, Artificial Sequence
  ALAS-1_reverse primer
cgtagatgttatgtctgctcat

SEQ ID NO: 82 - DNA, 22 bp, Artificial Sequence
  ALAS-1 probe
tttagcagcatctgcaacccgc

The invention claimed is:

1. A method for treating an individual having prostate cancer, comprising:
   determining, by processor circuitry, a prostate cancer progression state based on a gene expression profile including an expression level of at least two phosphodiesterase 4D (PDE4D) variants selected from the group consisting of PDE4D1, PDE4D2, PDE4D4, PDE4D5, PDE4D7, and PDE4D9, wherein none of the PDE4D variants serves as a reference gene, and wherein the gene expression profile is converted, by the processor circuitry, into at least one prostate cancer PDE index (PDE-Index) indicative of the presence of prostate cancer in the individual and indicative for the prostate cancer progression state of the indicated prostate cancer, wherein the prostate cancer progression state is a progressive prostate cancer progression state; and
   administering a prostate cancer therapy to the individual based on the determination that the prostate cancer progression state is a progressive prostate cancer progression state, wherein the prostate cancer therapy is selected from surgery, radiation therapy, hormone therapy, and chemotherapy.

2. The method of claim 1, wherein the gene expression profile is a normalized gene expression profile which is obtained by normalizing, by the processor circuitry, the expression level of the PDE4D variants to the expression of at least one reference gene, the method optionally comprising, before the normalization, the determining the expression level of at least one reference gene in a sample.

3. The method of claim 2, further comprising:
   monitoring or prognosticating, by the processor circuitry, prostate cancer or the progression state of prostate cancer.

4. The method of claim 1, comprising, before the determining the prostate cancer progression state, determining, by the processor circuitry, the expression level of at least two phosphodiesterase 4D (PDE4D) variants selected from the group consisting of PDE4D1, PDE4D2, PDE4D4, PDE4D5, PDE4D7, and PDE4D9 in a sample to obtain a gene expression profile.

5. A method for treating an individual having prostate cancer, comprising:
   receiving a determination by processor circuitry of a prostate cancer progression state based on a gene expression profile including an expression level of at least two phosphodiesterase 4D (PDE4D) variants selected from the group consisting of PDE4D1, PDE4D2, PDE4D4, PDE4D5, PDE4D7, and PDE4D9, wherein none of the PDE4D variants serves as a reference gene, and wherein the gene expression profile is converted, by the processor circuitry, into at least one prostate cancer PDE index (PDE-Index) indicative of the presence of prostate cancer in the individual and indicative for the prostate cancer progression state of the indicated prostate cancer, wherein the prostate cancer progression state is a progressive prostate cancer progression state; and
   administering a prostate cancer therapy to the individual based on the determination that the prostate cancer progression state is a progressive prostate cancer progression state, wherein the prostate cancer therapy is a compound directly stimulating the activity of a PDE4D variant;
   wherein the administered prostate cancer therapy compound is selected from the group consisting of: (i) a nucleic acid encoding a PDE4D variant selected from the group consisting of PDE4D1 (SEQ ID NO: 1), PDE4D2 (SEQ ID NO: 3), PDE4D4 (SEQ ID NO: 7), PDE4D5 (SEQ ID NO: 9), PDE4D7 (SEQ ID NO: 13), and PDE4D9 (SEQ ID NO: 17), (ii) a protein of a PDE4D variant selected from the group consisting of PDE4D1 (SEQ ID NO: 2), PDE4D2 (SEQ ID NO: 4), PDE4D4 (SEQ ID NO: 8), PDE4D5 (SEQ ID NO: 10), PDE4D7 (SEQ ID NO: 14), and PDE4D9 (SEQ ID NO: 18), (iii) cAMP or a cAMP analog; (iv) a demethylation agent (v) a biologically active mono or bivalent cation; (vi) 5-aza-2'-deoxycytidine; (vii) 5-azacytidine; and (viii) trichostatin A (TSA).

6. The method of claim 1, wherein the at least one PDE-Index is selected from the following:
   PDE-Index 1:
   PDE4D7_exp-PDE4D5_exp
   PDE-Index 2:
   MEAN(PDE4D7 _exp & PDE4D5_exp)
   PDE-Index 3:
   (MEAN(PDE4D5_exp & PDE4D7_exp & PDE4D9_exp))
   PDE-Index 4:
   (MEAN(PDE4D5_exp & PDE4D7_exp & PDE4D9 exp))/(PDE4D1&PDE4D2 exp)
   PDE-Index 5:
   (MEAN(PDE4D5_exp & PDE4D7_exp & PDE4D9_exp)).

7. The method of claim 1, wherein the at least two phosphodiesterase 4D (PDE4D) variants are selected from the group consisting of PDE4D5, PDE4D7, and PDE4D9.

8. The method of claim 5, wherein the at least two phosphodiesterase 4D (PDE4D) variants are selected from the group consisting of PDE4D5, PDE4D7, and PDE4D9.

9. The method of claim 5, wherein the nucleic acid sequence of the selected nucleic acid is at least 95% similar to the PDE4D variant.

10. The method of claim 5, wherein the nucleic acid sequence of the selected nucleic acid encoding the PDE4D variant is at least 99% similar to the PDE4D variant.

11. The method of claim 5, wherein the protein sequence of the selected protein of the PDE4D variant is at least 95% similar to the PDE4D variant.

12. The method of claim 5, wherein the protein sequence of the selected protein of the PDE4D variant is at least 99% similar to the PDE4D variant.

* * * * *